United States Patent 6,812,339 (POLYMORPHISMS IN KNOWN GENES ASSOCIATED WITH HUMAN DISEASE, METHODS OF DETECTION AND USES THEREOF) - sequence listing, part 6

SEQ ID NO: 9810 - protein, 723 aa, Human
EGCCCIAIMVQKYQSPVRVYKYPFELIMAAYERRFPTCPLIPMFVGSDTVNEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITPSSETSSSSSKKQAASMAVVIPEAALKEGLSGDALSSPSAPEPVVGTPDDKLDADYIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSINEEGLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 9811 - protein, 312 aa, Human
DALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 9812 - protein, 95 aa, Human
NSTMAYSGQGQKVQKVMVQPINLIFRYLQNRSQIQVWLYEQVNMQIEGCIIGFDEYMNLVLDDAEEIHSKTKSRKQLGRIMLKGDNITLLQSVSN

SEQ ID NO: 9813 - protein, 728 aa, Human
IDREDGPCQHPFEKTLENGRPCLITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGKLCGS

SEQ ID NO: 9814 - protein, 596 aa, Human
SLLLRFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 9815 - protein, 253 aa, Human
RKEPFFSLSLCNCSKGGELDIPRLISPGLTPSLLFILVLQKPSPLMAPLGEVGNYFGVQDAVPFGNVPVLPVDSPVLLSDHLGQSEAGGLPRGPAVTDLDHLKGILRRRQLYCRTGFHLEIFPNGTIQGTRKDHSRFGILEFISIAVGLVSIRGVDSGLYLGMNEKGELYGSEKLTQECVFREQFEENWYNTYSSNLYKHVDTGRRYYVALNKDGTPREGTRTKRHQKFTHFLPRPVDPDKVPELYKDILSQS

SEQ ID NO: 9816 - protein, 758 aa, Human
ITAKISSTAVTRPIATGYGSKTSLASSIGRPMTGAIQDGVTRPMTAVRAAGFTKAALRGSAFDPLSQSRGPASPLEAKKKDSPEEKIKQLEKEVNELVEESCIANSCGDLKLALEKAKDAGRKERVLVRQREQVTTPENINLDLTYSVLFNLASQYSVNEMYAEALNTYQVIVKNKMFSNAGILKMNMGNIYLKQRNYSKAIKFYRMALDQVPSVNKQMRIKIMQNIGVTFIQAGQYSDAINSYEHIMSMAPNLKAGYNLTICYFAIGDREKMKKAFQKLITVPLEIDEDKYISPSDDPHTNLVTEAIKNDHLRQMERERKAMAEKYIMTSAKLIAPVIETSFAAGYDWCVEVVKASQYVELANDLEINKAVTYLRQKDYNQAVEILKVLEKKDNRVKSAAATNLSALYYMGKDFAQASSYADIAVNSDRYNPAALTNKGNTVFANGDYEKAAEFYKEALRNDSSCTEALYNIGLTYEKLNRLDEALDCFLKLHAILRNSAEVLYQIANIYELMENPSQAIEWLMQVVSVIPTDPQVLSKLGELYDREGDKSQAFQYYYESYRYFPCNIEVIEWLGAYYIDTQFWEKAIQYFERASLIQPTQVKWQLMVASCFRRSGNYQKALDTYKDTHRKFPENVECLRFLVRLCTDLGLKDAQEYARKLKRLEKMKEIREQRIKSGRDGSGGSRGKREGSASGDSGQNYSASSKGERLSARLRALPGTNEPYESSSNKEIGKCLLCGPTWPSNRTTKNCSQEKDR

SEQ ID NO: 9817 - protein, 307 aa, Human
LPVTLIFAKMKTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFKKLNNLTFLYLDHNALESVPLNLPESLRVIHLQFNNIASITDDTFCKANDTSYIRDRIEEIRLEGNPIVLGKHPNSFICLKRLPIGSYF

SEQ ID NO: 9818 - protein, 307 aa, Human; identical to SEQ ID NO: 9817

SEQ ID NO: 9819 - protein, 720 aa, Human
DTKQSLLSLDLQKLAGGKKSNMKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATVSYSLLSGIALNDRNEFSGDSSEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRNILPEEICNAEEDDDSNLEHLHLENNYIKIREIPSYTFSCIRSYSSIVLKPQNIK

SEQ ID NO: 9820 - protein, 473 aa, Human
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 9821 - protein, 1054 aa, Human
LSPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 9822 - protein, 1054 aa, Human; identical to SEQ ID NO: 9821

SEQ ID NO: 9823 - protein, 454 aa, Human
PGMGTPASPALPPATAARARVVHCTVKTDSRRRELTPPIPDAMSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 9824 - protein, 78 aa, Human
EIRHSKHSGGRSSQGHSEASVFDAYVLPKLCVKLHYRVSCAIHSKVVRNRSREARKDRTPPPRFRPAGAAPCLPPKPM

SEQ ID NO: 9825 - protein, 147 aa, Human
AKMKFNPFVTSDRSKNRKRHFNAPSHIRRKIMSSPLSKELRQKYNVRSMPIRKDDEVQVVRGHYKGQQIGKVVQVYRKKYVIYIERVQREKANGTTVHVGIHPSKVVITRLKLDKDRKKILERKAKSRQVGKEKGKYKEETIEKMQE

SEQ ID NO: 9826 - protein, 363 aa, Human
GRESSSALDPSSPPPFSLRMAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPTGAQDLISKLLRHNPSERLPLAQVSAHPWVRANSRRVLPPSALQSVA

SEQ ID NO: 9827 - protein, 1136 aa, Human
KRLCMGMACLTMTEMEGTSTSSIYQNGDISGNANSMKQIDPVLQVYLYHSLGKSEADYLTFPSGEYVAEEICIAASKACGITPVYHNMFALMSETERIWYPPNHVFHIDESTRHNVLYRIRFYFPRWYCSGSNRAYRHGISRGAEAPLLDDFVMSYLFAQWRHDFVHGWIKVPVTHETQEECLGMAVLDMMRIAKENDQTPLAIYNSISYKTFLPKCIRAKIQDYHILTRKRIRYRFRRFIQQFSQCKATARNLKLKYLINLETLQSAFYTEKFEVKEPGSGPSGEEIFATIIITGNGGIQWSRGKHKESETLTEQDLQLYCDFPNIIDVSIKQANQEGSNESRVVTIHKQDGKNLEIELSSLREALSFVSLIDGYYRLTADAHHYLCKEVAPPAVLENIQSNCHGPISMDFAISKLKKAGNQTGLYVLRCSPKDFNKYFLTFAVERENVIEYKHCLITKNENEEYNLSGTKKNFSSLKDLLNCYQMETVRSDNIIFQFTKCCPPKPKDKSNLLVFRTNGVSDVPTSPTLQRPTHMNQMVFHKIRNEDLIFNESLGQGTFTKIFKGVRREVGDYGQLHETEVLLKVLDKAHRNYSESFFEAASMMSKLSHKHLVLNYGVCVCGDENILVQEFVKFGSLDTYLKKNKNCINILWKLEVAKQLAWAMHFLEENTLIHGNVCAKNILLIREEDRKTGNPPFIKLSDPGISITVLPKDILQERIPWVPPECIENPKNLNLATDKWSFGTTLWEICSGGDKPLSALDSQRKLQFYEDRHQLPAPKWAELANLINNCMDYEPDFRPSFRAIIRDLNSLFTPDYELLTENDMLPNMRIGALGFSGAFEDRDPTQFEERHLKFLQQLGKGNFGSVEMCRYDPLQDNTGEVVAVKKLQHSTEEHLRDFEREIEILKSLQHDNIVKYKGVCYSAGRRNLKLIMEYLPYGSLRDYLQKHKERIDHIKLLQYTSQICKGMEYLGTKRYIHRDLATRNILVENENRVKIGDFGLTKVLPQDKEYYKVKEPGESPIFWYAPESLTESKFSVASDVWSFGVVLYELFTYIEKSKSPPAEFMRMIGNDKQGQMIVFHLIELLKNNGRLPRPDGCPDEIYMIMTECWNNNVNQRPSFRDLALRVDQIRDNMAG

SEQ ID NO: 9828 - protein, 464 aa, Human
PRRGLASTATCKSAQLYFCAGSRSCLLSLWQPSSWSLKMETNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPVCEGD

SEQ ID NO: 9829 - protein, 737 aa, Human
QELYFKNLSKRNKQIMEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 9830 - protein, 1047 aa, Human
MALPSLLLLVAALAGGVRPPGARNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQPAAHYSGAEKQIWWTGRPIPWVKGAPPSDNPPCAFDLDDPSCDKTPLSTLAIVALGTGITFIMFGVSSFLIFRKLMLEKELASMLWRIRWEELQFGNSERYHKGAGSRLTLSLRGSSYGSLMTAHGKYQIFANTGHFKGNVVAIKHVNKKRIELTRQVLFELKHMRDVQFNHLTRFIGACIDPPNICIVTEYCPRGSLQDILENDSINLDWMFRYSLINDLVKGMAFLHNSIISSHGSLKSSNCVVDSRFVLKITDYGLASFRSTAEPDDSHALYAKKLWTAPELLSGNPLPTTGMQKADVYSFGIILQEIALRSGPFYLEGLDLSPKEIVQKVRNGQRPYFRPSIDRTQLNEELVLLMERCWAQDPAERPDFGQIKGFIRRFNKEGGTSILDNLLLRMEQYANNLEKLVEERTQAYLEEKRKAEALLYQILPHSVAEQLKRGETVQAEAFDSVTIYFSDIVGFTALSAESTPMQVVTLLNDLYTCFDAIIDNFDVYKVETIGDAYMVVSGLPGRNGQRHAPEIARMALALLDAVSSFRIRHRPHDQLRLRIGVHTGPVCAGVVGLKMPRYCLFGDTVNTASRMESNGQALKIHVSSTTKDALDELGCFQLELRGDVEMKGKGKMRTYWLLGERKGPPGLL

SEQ ID NO: 9831 - protein, 1047 aa, Human; identical to SEQ ID NO: 9830

SEQ ID NO: 9832 - protein, 1001 aa, Human
PRASGGGSGGSGCGQAGSEHPAALEPPGPDMATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYENALFSCISRNEMGSVCCSYAGHHTNCREYCQAIFRTDSSPGPSQIKAVENYCASISPQLIHCVNNYTQSYPMRNPTDSLYCCDRAEDHACQNACKRILMSKKTEMEIVDGLIEGCKTQPLPQDPLWQCFLESSQSVHPGVTVHPPPSTGLDGAKLHCCSKANTSTCRELCTKLYSMSWGNTQSWQEFDRFCEYNPVEVSMLTCLADVREPCQLGCRNLTYCTNFNNRPTELFRSCNAQSDQGAMNDMKLWEKGSIKMPFINIPVLDIKKCQPEMWKAIACSLQIKPCHSKSRGSIICKSDCVEILKKCGDQNKFPEDHTAESICELLSPTDDLKNCIPLDTYLRPSTLGNIVEEVTHPCNPNPCPANELCEVNRKGCPSGDPCLPYFCVQGCKLGEASDFIVRQGTLIQVPSSAGEVGCYKICSCGQSGLLENCMEMHCIDLQKSCIVGGKRKSHGTSFSIDCNVCSCFAGNLVCSTRLCLSEHSSEDDRRTFTGLPCNCADQFVPVCGQNGRTYPSACIARCVGLQDHQFEFGSCMSKDPCNPNPCQKNQRCIPKPQVCLTTFDKFGCSQYECVPRQLACDQVQDPVCDTDHMEHNNLCTLYQRGKSLSYKGPCQPFCRATEPVCGHNGETYSSVCAAYSDRVAVDYYGDCQAVGVLSEHSSVAECASVKCPSLLAAGCKPIIPPGACCPLCAGMLRVLFDKEKLDTIAKVTNKKPITVLEILQKIRMHVSVPQCDVFGYFSIESEIVILIIPVDHYPKALQIEACNKEAEKIESLINSDSPTLASHVPLSALIISQVQVSSSVPSAGVRARPSCHSLLLPLSLGLALHLLWTYN

SEQ ID NO: 9833 - protein, 204 aa, Human
SIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRFGPYYTEPVIAGLDPKTFKPFICSLDLIGCPMVTDDFVVSGTCAEQMYGMCESLWEPNMDPDHLFETISQAMLNAVDRDAVSGMGVIVHIIEKDKITTRTLKARMD

SEQ ID NO: 9834 - protein, 148 aa, Human
FFFFPAFKMSKRGRGGSSGAKFRISLGLPVGAVINCADNTGAKNLYIISVKGIKGRLNRLPAAGVGDMVMATVKKGKPELRKKVHPAVVIRQRKSYRRKDGVFLYFEDNAGVIVNNKGEMKGSAITGPVAKECADLWPRIASNAGSIA

SEQ ID NO: 9835 - protein, 286 aa, Human
ASRQLASGNRTRVSSGVPAPAFLGTMNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 9836 - protein, 494 aa, Human
GSPAGPGRRREGRLLSMVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 9837 - protein, 205 aa, Human
FPFAAAAAAMSMLRLQKRLASSVLRCGKKKVWLDPNETNEIANANSRQQIRKLIKDGLIIRKPVTVHSRARCRKNTLARRKGRHMGIGKRKGTANARMPEKVTWMRRMRILRRLLRRYRESKKIDRHMYHSLYLKVKGNVFKNKRILMEHIHKLKADKARKKLLADQAEARRSKTKEARKRREERLQAKKEEIIKTLSKEEETKK

SEQ ID NO: 9838 - protein, 221 aa, Human
MTTQLRVVHLLPLLLACFVQTSPKQEKMKMDCHKDEKGTIYDYEAIALNKNEYVSFKQYVGKHILFVNVATYCGLTAQYPELNALQEELKPYGLVVLGFPCNQFGKQEPGDNKEILPGLKYVRPGGGFVPSFQLFEKGDVNGEKEQKVFSFLKHSCPHPSEILGTFKSISWDPVKVHDIRWNFEKFLVGPDGIPVMRWSHRATVSSVKTDILAYLKQFKTK

SEQ ID NO: 9839 - protein, 221 aa, Human; identical to SEQ ID NO: 9838

SEQ ID NO: 9840 - protein, 583 aa, Human
AFQALMAEESRKPSAPSPPDQTPEEDLVIVKVEEDHGWDQESSLHESNPLGQEVFRLRFRQLRYQETLGPREALIQLRALCHQWLRPDLNTKEQILELLVLEQFLTILPEELQTLVKEHQLENGEEVVTLLEDLERQIDILGRPVSARVHGHRVLWEEVVHSASAPEPPNTQLQSEATQHKSPVPQESQERAMSTSQSPTRSQKGSSGDQEMTATLLTAGFQTLEKIEDMAVSLIREEWLLDPSQKDLCRDNRPENFRNMFSLGGETRSENRELASKQVISTGIQPHGETAAKCNGDVIRGLEHEEARDLLGRLERQRGNPTQERRHKCDECGKSFAQSSGLVRHWRIHTGEKPYQCNVCGKAFSYRSALLSHQDIHNKVKRYHCKECGKAFSQNTGLILHQRIHTGEKPYQCNQCGKAFSQSAGLILHQRIHSGERPYECNECGKAFSHSSHLIGHQRIHTGEKPYECDECGKTFRRSSHLIGHQRSHTGEKPYKCNECGRAFSQKSGLIEHQRIHTGERPYKCKECGKAFNGNTGLIQHLRIHTGEKPYQCNECGKAFIQRSSLIRHQRIHSGEKSESISV

SEQ ID NO: 9841 - protein, 493 aa, Human
PPALEKHKMATEPKKAAAQNSPEDEGLLIVKIEEEEFIHGQDTCLQRSELLKQELCRQLFRQFCYQDSPGPREALSRLRELCCQWLKPEIHTKEQILELLVLEQFLTILPGDLQAWVHEHYPESGEEAVTILEDLERGTDEAVLQVQAHEHGQEIFQKKVSPPGPALNVKLQPVETKAHFDSSEPQLLWDCDNESENSRSMPKLEIFEKIESQRIISGRISGYISEASGESQDICKSAGRVKRQWEKESGESQRLSSAQDEGFGKILTHKNTVRGEIISHDGCERRLNLNSNEFTHQKSCKHGTCDQSFKWNSDFINHQIIYAGEKNHQYGKSFKSPKLAKHAAVFSGDKTHQCNECGKAFRHSSKLARHQRIHTGERCYECNECGKSFAESSDLTRHRRIHTGERPFGCKECGRAFNLNSHLIRHQRIHTREKPYECSECGKTFRVSSHLIRHFRIHTGEKPYECSECGRAFSQSSNLSQHQRIHMRENLLM

SEQ ID NO: 9842 - protein, 427 aa, Human
LPPCAFRVSQAPPRFVLKHSSSWRVPFKLFKVKMNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQCSQCSKSYSRRSFLIEHQRSHTGERPHQCIECGKSFNRHCNLIRHQKIHTVAELV

SEQ ID NO: 9843 - protein, 428 aa, Human
RPGENMASALEQFVNSVRQLSAQGQMTQLCELINKSGELLAKNLSHLDTVLGALDVQEHSLGVLAVLFVKFSMPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGGMIYTGLKNFERALYFYEQAITTPAMAVSHIMLESYKKYILVSLILLGKVQQLPKYTSQIVGRFIKPLSNAYHELAQVYSTNNPSELRNLVNKHSETFTRDNNMGLVKQCLSSLYKKNIQRLTKTFLTLSLQDMASRVQLSGPQEAEKYVLHMIEDGEIFASINQKDGMVSFHDNPEKYNNPAMLHNIDQEMLKCIELDERLKAMDQEITVNPQFVQKSMGSQEDDSGNKPSSYS

SEQ ID NO: 9844 - protein, 228 aa, Human
QLRLFVGDLWDSSYSCSSADLLAVADFCVMTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIMALLYEEPFTAEIYRQKASGSHKRS

SEQ ID NO: 9845 - protein, 1164 aa, Human
PYEGGGPGGPPGGGGCAMDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 9846 - protein, 334 aa, Human
ARVPLGTARAAASLWGRYLRARTPRSPPRSPSRAPRAPQRWGLLLRGGNVWPAPAARRGPGPRAHDGPARWAMIRLGGWCARRLCSAAVPAGRRGAAGGLGLAGGRALRVLVDMDGVLADFEGGFLRKFRARFPDQPFIALEDRRGFWVSEQYGRLRPGLSEKAISIWESKNFFFELEPLPGAVEAVKEMASLQNTDVFICTSPIKMFKYCPYEKYAWVEKYFGPDFLEQIVLTRDKTVVSADLLIDDRPDITGKGRANPQLGACPLHRLPQPAPAAAAPPPQAALVGGRLEGHSGQQAALLSWTVLRAPLWGSDLRAPSSGPVGPVCWSGSPS

SEQ ID NO: 9847 - protein, 759 aa, Human
QRLMLTMGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 9848 - protein, 330 aa, Human
MPRSFLVKSKKAHTYHQPRVQEDEPLWPPALTPVPRDQAPSNSPVLSTLFPNQCLDWTNLKREPELEQDQNLARMAPAPEGPIVLSRPQDGDSPLSDSPPFYKPSFSWDTLATTYGHSYRQAPSTMQSAFLEHSVSLYGSPLVPSTEPALDFSLRYSPGMDAYHCVKCNKVFSTPHGLEVHVRRSHSGTRPFACDICGKTFGHAVSLEQHTHVHSQERSFECRMCGKAFKRSSTLSTHLLIHSDTRPYPCQFCGKRFHQKSDMKKHTYIHTGEKPHKCQVCGKAFSQSSNLITHSRKHTGFKPFSCELCTKGFQRKVDLRRHRESQHNLK

SEQ ID NO: 9849 - protein, 347 aa, Human
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 9850 - protein, 931 aa, Human
TGPVLWKVGGGARVPGMAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 9851 - protein, 503 aa, Human
PRTFGGPVGRPGRAGTEPPRLGQWAWAGAVAEDLARPLQTPGDSHTAAAMATNKERLFAAGALGPGSGYPGAGFPFAFPGALRGSPPFEMLSPSFRGLGQPDLPKEMASLSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 9852 - protein, 388 aa, Human
AGPEGEEPSAARGRGTRSVCREPGSCGWGLPPGPEPACPPTAPPRPCHPCRPVPISLSASAGPWSGSRGGSMLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGICTLRFELRYRAERSKTFTTWMVKDLQHHCVIHDAWSGLRHVVQLRAQEEFGQGEWSEWSPEAMGTPWTDRLSPRCPGWSTAVQSQLTATSASWVQAILPPQPPK

SEQ ID NO: 9853 - protein, 1456 aa, Human
LSSGTPGERSMCGRCVSSACAGHHLRAAESPSGSLDILSNRHPQTPLQPRSAPGSLALCAQLSCAAGCREFHLRASFSRQALGERTGSRVLGISPGSRCRMQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 9854 - protein, 521 aa, Human
TMSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 9855 - protein, 452 aa, Human
LRIPGAQRVGQRQPRPHPAKCGALPRGGLNHEAGAEERSLPPWDSTDPVPGPGQGAPQGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSTGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLE

SEQ ID NO: 9856 - protein, 160 aa, Human
LAPQRTRAPSPRAAPRPTRSMLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 9857 - protein, 641 aa, Human
CLAMSASSSGGSPRFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 9858 - protein, 480 aa, Human
IGRLIIGQNGILSTPAVSCIIRKIKAAGGIILTASHCPGGPGGEFGVKFNVANGGPAPDVVSDKIYQISKTIEEYAICPDLQIDLSRLGRQEFDLENKFKPFRVEIVDPVDIYLNLLRTIFDFHAIKSLLTGPSQLKIRVDAMHGVMGPYVRKVLCDELGAPANSAINCVPLEDFGGQHPDPNLTYATTLLEAMKGGEYGFGAAFDADGDRYMILGQNGFFVSPSDSLAIIAANLSCIPYFRQMGVRGFGRSMPTSMALDRVAKSMKVPVYETPAGWRFFSNLMDSGRCNLCGEESFGTGSDHLREKDGLWAVLVWLSIIAARKQSVEEIVRDHWAKFGRHYYCRFDYEGLDPKTTYYIMRDLEALVTDKSFIGQQFAVGSHVYSVAKTDSFEYVDPVDGTVTKKQGLRIIFSDASRLIFRLSSSSGVRATLRLYAESYERDPSGHDQEPQAVLSPLIAIALKISQIHERTGRRGPTVIT

SEQ ID NO: 9859 - protein, 470 aa, Human
GRLGFPEGPEGGRGRHVRAARGPVGPRAGEGPCAAWVGVGPGSAPGTSLREGPGAGAPQRPAGGRASGRAARSRPEARAEGAPSPVVGAPPAGSAGWAAPGPAMSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 9860 - protein, 507 aa, Human [sequence omitted]

SEQ ID NO: 9861 - protein, 255 aa, Human
APPGLFPVASPELKRCGMARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 9862 - protein, 510 aa, Human
REAAGLGADCRAGRLVVMPGFLVRILPLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFK

SEQ ID NO: 9863 - protein, 391 aa, Human
DSWQEAAWGPQLLQQTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 9864 - protein, 159 aa, Human
FHKMAPKAKKEAPAPPKAEAKAKALKAKKAVLKGVHSHKKKKIRTSPTFRRPKTLRLRRQPKYPRKSAPRRNKLDHYAIIKFPLTTESAMKKIEDNNTLVFIVDVKANKHQIKQAVKKLYDIDVAKVNTLIRPDGEKKAYVRLAPDYDALDVANKIGII

SEQ ID NO: 9865 - protein, 224 aa, Human
VFFEDLGLRDTVRMAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 9866 - protein, 599 aa, Human
QPLLLHTMATCWQALWAYRSYLIVFFVPILLLPLPILVPSKEAYCAYAIILMALFWCTEALPLAVTALFPLILFPMMGIVDASEVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFLGWGNLAFPNAKGESMVSDGTVAIFIGIIMFIIPSKFPGLTQDPENPGKLKAPLGLLDWKTVNQKMPWNIVLLLGGGYALAKGSERSGLSEWLGNKLTPLQSVPAPAIAIILSLLVATFTECTSNVATTTIFLPILASMAQAICLHPLYVMLPCTLATSLAFMLPVATPPNAIVFSFGDLKVLDMARAGFLLNIIGVLIIALAINSWGIPLFSLHSFPSWAQSNTTAQCLPSLANTTTPSP

SEQ ID NO: 9867 - protein, 483 aa, Human
ARSPAMAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 9868 - protein, 366 aa, Human
PDMSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 9869 - protein, 363 aa, Human
ILLAGSPSPRDQCSQRQSSGGDKELVTRGCTFSTAVVSPSAMTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKVARSPLKEFDKEKAWRAVVVQMAQ

SEQ ID NO: 9870 - protein, 351 aa, Human
SGEAKCERPRTPALSLPAARTTMTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 9871 - protein, 186 aa, Human
KPGREKQEGTMASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 9872 - protein, 351 aa, Human
PEPEPQPPVPSFPAAAQPPSGLPRARAQTRLQPRGAGSLALPLGSLSGLGHRVLWGGRLPARPPAAPSLRGPWAAAAMGTDSRAAKALLARARTLHLQTGNLLNWGRLRKKCPSTHSEELHDCIQKTLNEWSSQINPDLVREFPDVLECTVSHAVEKINPDEREEMKVSAKLFIVESNSSSSTRSAVDMACSVLGVAQLDSVIIASPPIEDGVNLSLEHLQPYWEELENLVQSKKIVAIGTSDLDKTQLEQLYQWAQVKPNSNQVNLASCCVMPPDLTAFAKQFDIQLLTHNDPKELLSEASFQEALQESIPDIQAHEWVPLWLLRYSVIVKSRGIIKSKGYILQAKRRGS

SEQ ID NO: 9873 - protein, 622 aa, Human
KKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 9874 - protein, 336 aa, Human
KTASSPHPLALPLAGPGRLQPNLPSPTGATEPARSRRQLVDMETPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 9875 - protein, 207 aa, Human
VLSFSLSDRAQRCNCRMGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWAFNMYDLDGDGKITRVEMLEIIEAIYKMVGTVIMMKMNEDGLTPEQRVDKIFSKMDKNKDDQITLDEFKEAAKSDPSIVLLLQCDIQK

SEQ ID NO: 9876 - protein, 325 aa, Human
GATDMGEPQGSMRILVTGGSGLVGKAIQKVVADGAGLPGEDWVFVSSKDADLTDTAQTRALFEKVQPTHVIHLAAMVGGLFRNIKYNLDFWRKNVHMNDNVLHSAFEVGARKVVSCLSTCIFPDKTTYPIDETMIHNGPPHNSNFGYSYAKRMIDVQNRAYFQQYGCTFTAVIPTNVFGPHDNFNIEDGHVLPGLIHKVHLAKSSGSALTVWGTGNPRRQFIYSLDLAQLFIWVLREYNEVEPIILSVGEEDEVSIKEAAEAVVEAMDFHGEVTFDTTKSDGQFKKTASNSKLRTYLPDFRFTPFKQAVKETCAWFTDNYEQARK

SEQ ID NO: 9877 - protein, 304 aa, Human
FISLPASADSSSLVAASLAGVRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 9878 - protein, 507 aa, Human
KSEPRVGSWPPTDTTRPTEPTMPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDPCVLGTHQCQHVCISDGEGKHHCECSQGYTLNADKKTCSALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 9879 - protein, 1336 aa, Human
RVSVSVAEMESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSQVNGAPGSPTEPAGQKQHQKALPKKGVLGKSPLSALARKKARLSLVIRSPSLLQSGAKKKAQVRKAGKP

SEQ ID NO: 9880 - protein, 308 aa, Human
PAAPQVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEIKEERKIQKHKTLPKMSGGWELELNGTEAKLVRKVAGEKITVTFNINNSIPPTFDGEEEPSQGQKVEEQEPELTSTPNFVVEVIKNDDGKKALVLDCHYPEDEVGQEDEAESDIFSIREVSFQSTGESEWKDTNYTLNTDSLDWALYDHLMDFLADRGVDNTFADELVELSTALEHQEYITFLEDLKSFVKSQ

SEQ ID NO: 9881 - protein, 680 aa, Human
ISAGTEPGFLSNRDCDAFGLAGRCFLSHFLLGPASAAAVPQFAPGGGRAAVPSAVRPRGCHRPSESSGAAEGFATEGGGGLREEEAEEAEEEGRKMAAVELEWIPETLYNTAISAVVDNYIRSRRDIRSLPENIQFDVYYKLYQQGRLCQLGSEFCELEVFAKVLRALDKRHLLHHCFQALMDHGVKVASVLAYSFSRRCSYIAESDAAVKEKAIQVGFVLGGFLSDAGWYSDAEKVFLSCLQLCTLHDEMLHWFRAVECCVRLLHVRNGNCKYHLGEETFKLAQTYMDKLSKHGQQANKAALYGELCALLFAKSHYDEAYKWCIEAMKEITAGLPVKVVVDVLRQASKACVVKREFKKAEQLIKHAVYLARDHFGSKHPKYSDTLLDYGFYLLNVDNICQSVAIYQAALDIRQSVFGGKNIHVATAHEDLAYSSYVHQYSSGKFDNALFHAERAIGIITHILPEDHLLLASSKRVKALILEEIAIDCHNKETEQRLLQEAHDLHLSSLQLAKKAFGEFNVQTAKHYGNLGRLYQSMRKFKEAEEMHIKAIQIKEQLLGQEDYEVALSVGHLASLYNYDMNQYENAEKLYLRSIAIGKKLFGEGYSGLEYDYRGLIKLYNSIGNYEKVFEYHNVLSNWNRLRDRQYSVTDALEDVSTSPQSTEEVVQSFLISQNVEGPSC

SEQ ID NO: 9882 - protein, 978 aa, Human
NMAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 9883 - protein, 794 aa, Human
WPQPRRRAPAAAAAQPGPAAAPQPCSPAAPAAPSPARTAPGGGPQRGHKDPRRRLSADRSYLKSIMSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIALDHGFTIKRSGSLDYYQQPGMYWIRPPLLIRRGRFSDEDATRM

SEQ ID NO: 9884 - protein, 718 aa, Human
PGPDVPMREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRRMFPPFKVRVSGLDKKAKYILLMDIVAADDCRYKFHNSRWMVAGKADPEMPKRMYIHPDSPATGEQWMAKPVAFHKLKLTNNISDKHGFTILNSMHKYQPRFHIVRANDILKLPYSTFRTYVFPETDFIAVTAYQNDKITQLKIDNNPFAKGFRDTGNGRREKRKQLTLPSLRLYEEHCKPERDGAESDASSCDPPPAREPPTSPGAAPSPLRLHRARAEEKSCAADSDPEPERLSEERAGAPLGRSPAPDSASPTRLTEPERARERRSPERGKEPAESGGDGPFGLRSLEKERAEARRKDEGRKEAAEGKEQGLAPLVVQTDSASPLGAGHLPGLAFSSHLHGQQFFGPLGAGQPLFLHPGQFTMGPGAFSAMGMGHLLASVAGGGNGGGGGPGTAAGLDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 9885 - protein, 261 aa, Human
GPRARPPVLTRRSSWPPRRSRGSMRFKNRFQRFMNHRAPANGRYKPTCYEHAANCYTHAFLIVPAIVGSALLHRLSDDCWEKITAWIYGMGLCALFIVSTVFHIVSWKKSHLRTVEHCFHMCDRMVIYFFIAASYAPWLNLRELGPLASHMRWFIWLMAAGGTIYVFLYHEKYKVVELFFYLTMGFSPALVVTSMNNTDGLQELACGGLIYCLGVVFFKSDGIIPFAHAIWHLFVATAAAVHYYAIWKYLYRSPTDFMRHL

SEQ ID NO: 9886 - protein, 550 aa, Human
KEKTERVEDKEKSTTETRKVRERESSPNYKAMSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 9887 - protein, 1695 aa, Human
PTKATEMAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMVPPPQNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDMTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 9888 - protein, 268 aa, Human
MPRSFLVKKHFNASKKPNYSELDTHTVIISPYLYESYSMPVIPQPEILSSGAYSPITVWTTAAPFHAQLPNGLSPLSGYSSSLGRVSPPPPSDTSSKDHSGSESPISDEEERLQSKLSDPHAIEAEKFQCNLCNKTYSTFSGLAKHKQLHCDAQSRKSFSCKYCDKEYVSLGALKMHIRTHTLPCVCKICGKAFSRPWLLQGHIRTHTGEKPFSCPHCNRAFADRSNLRAHLQTHSDVKKYQCKNCSKTFSRMSLLHKHEESGCCVAH

SEQ ID NO: 9889 - protein, 344 aa, Human
AVHISPLQPPSPYPSFISFFHLAEPSRTFSMYKMEYSYLNSSAYESCMAGMDTSSLASAYADFSSCSQASGFQYNPIRTTFGATSGCPSLTPGSCSLGTLRDHQSSPYAAVPYKLFTDHGGLNEKRKQRRIRTTFTSAQLKELERVFAETHYPDIYTREELALKIDLTEARVQVWFQNRRAKFRKQERAAAAAAAAAKNGSSGKKSDSSRDDESKEAKSTDPDSTGGPGPNPNPTPSCGANGGGGGGPSPAGAPGAAGPGGPGGEPGKGGAAAAAAAAAAAAAAAAAAAAGGLAAAGGPGQGWAPGPGPITSIPDSLGGPFASVLSSLQRPNGAKAALVKSSMF

SEQ ID NO: 9890 - protein, 764 aa, Human
RAGAEEAREEGQRGSWKMADEAALALQPGGSPSAAGADREAASSPAGEPLRKRPRRDGPGLERSPGEPGGAAPEREVPAAARGCPGAAAAALWREAEAEAAAAGGEQEAQATAAAGEGDNGPGLQGPSREPPLADNLYDEDDDDEGEEEEEAAAAAIGYRDNLLFGDEIITNGFHSCESDEEDRASHASSSDWTPRPRIGPYTFVQQHLMIGTDPRTILKDLLPETIPPPELDDMTLWQIVINILSEPPKRKKRKDINTIEDAVKLLQECKKIIVLTGAGVSVSCGIPDFRSRDGIYARLAVDFPDLPDPQAMFDIEYFRKDPRPFFKFAKEIYPGQFQPSLCHKFIALSDKEGKLLRNYTQNIDTLEQVAGIQRIIQCHGSFATASCLICKYKVDCEAVRGDIFNQVVPRCPRCPADEPLAIMKPEIVFFGENLPEQFHRAMKYDKDEVDLLIVIGSSLKVRPVALIPSSIPHEVPQILINREPLPHLHFDVELLGDCDVIINELCHRLGGEYAKLCCNPVKLSEITEKPPRTQKELAYLSELPPTPLHVSEDSSSPERTSPPDSSVIVTLLDQAAKSNDDLDVSESKGCMEEKPQEVQTSRNVESIAEQMENPDLKNVGSSTGEKNERTSVAGTVRKCWPNRVAKEQISRRLDGNQYLFLPPNRYIFHGAEVYSDSEDDVLSSSSCGSNSDSGTCQSPSLEEPMEDESEIEEFYNGLEDEPDVPERAGGAGFGTDGDDQEAINEAISVKQEVTDMNYPSNKS

SEQ ID NO: 9891 - protein, 192 aa, Human
PRRCPRPSPGPAMGLTVSALFSRIFGKKQMRILMVGLDAAGKTTILYKLKLGEIVTTIPTIGFNVETVEYKNICFTVWDVGGQDKIRPLWRHYFQNTQGLIFVVDSNDRERVQESADELQKMLQEDELRDAVLLVFANKQDMPNAMPVSELTDKLGLQHLRSRTWYVQATCATQGTGLYDGLDWLSHELSKR

SEQ ID NO: 9892 - protein, 122 aa, Human
SPVRASKMTKKRRNNGRAKKGRGHVQPVRCTNCARCVPKDKAIKKFVIRNIVEAVAVRDISEASVFDAYVLPKLYVKLHYCVSCAIHSKVVRNRSREARKDRTPPPRFRPAGAAPRPPPKPM

SEQ ID NO: 9893 - protein, 456 aa, Human
AQRAGVVGARGRSRLSMGSSHLLNKGLPLGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYRYPPGVVGVAPTGIPAAVEGIVPSAMSLSHGLPPVAHPPHAPSPGQTVKPEADRDHASDQL

SEQ ID NO: 9894 - protein, 176 aa, Human
FSCMDWEILGTDGQKPLQVSEVHISNISARMRLLGLLTLNMNIAMPSWFDIIGLSPDSQEDESGIKQAAQNIKALIDQEVKNGIPSNRIILGGFSQGGALSLYTALTTHQKLAGVTALNCWLPLWASFPQGPIGGANRDISILQCHGDCDPLVPLMFGSLTVEKLKNIGESSQCDL

SEQ ID NO: 9895 - protein, 189 aa, Human
YCSAAMAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRKATLELTHNWGTEDDETQSYHNGNSDPRGFGHIGIAVPDVYSACKRFEELGVKFVKKPDDGKMKGLAFIQDPDGYWIEILNPNKMATLM

SEQ ID NO: 9896 - protein, 295 aa, Human
ASERGRGARRAPGSQRDLGRGARSRRAWRAPRGDPAGRERSTARTSPGPMYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESADCLEICMECCGLCFSS

SEQ ID NO: 9897 - protein, 579 aa, Human
APRPPEAQGSLLGQDSLPEVPCPRLCTAGRQRSALAEASSEEHRGGGMESAEPAGQARAAATKLSEAVGAALQEPRRQRRLVLVIVCVALLLDNMLYMVIVPIVPDYIAHMRGGGEGPTRTPEVWEPTLPLPTPANASAYTANTSASPTAAWPAGSALRPRYPTESEDVKIGVLFASKAILQLLVNPLSGPFIDRMSYDVPLLIGLGVMFASTVLFAFAEDYATLFAARSLQGLGSAFADTSGIAMIADKYPEEPERSRALGVALAFISFGSLVAPPFGGILYEFAGKRVPFLVLAAVSLFDALLLLAVAKPFSAAARARANLPVGTPIHRLMLDPYIAVVAGALTTCNIPLAFLEPTIATWMKHTMAASEWEMGMAWLPAFVPHVLGVYLTVRLAARYPHLQWLYGALGLAVIGASSCIVPACRSFAPLVVSLCGLCFGIALVDTALLPTLAFLVDVRHVSVYGSVYAIADISYSVAYALGPIVAGHIVHSLGFEQLSLGMGLANLLYAPVLLLLRNVGLLTRSRSERDVLLDEPPQGLYDAVRLRERPVSGQDGEPRSPPGPFDECEDDYNYYYTRS

SEQ ID NO: 9898 - protein, 123 aa, Human
SPRRLSPRSQRVSATSSIDLPTLPTPSLGSVLVPILPKGSGCAGQRPRPRIKPRPRLQLQLQFQLRLPKVPRPLQRLQSRYLCQCEDRRTGATPHPRPWATICMGLGSSCAICTNKPEAGKKK

SEQ ID NO: 9899 - protein, 781 aa, Human
SPVWAAGLGGGGRREPSRGKGGAALRARHRSTMAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREWEEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 9900 - protein, 392 aa, Human
YSPRHPGCAHAVPVCSWRASGHREPPAQPAPAPQEPAKMPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQVQVCTAAGLSLGIILSLALAGILGICIVVVVSIWLFRRKSIKKGDNKGVIYKPATKMETEAHA

SEQ ID NO: 9901 - protein, 1005 aa, Human
NKTCSCTMVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 9902 - protein, 633 aa, Human
GHGCGRCLYPRHGSPGSRTARLQAEGRSGGGWARVSPGLSGWHRSRPHRAPRGIMSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 9903 - protein, 350 aa, Human
GAGVSSARGCRGTMAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 9904 - protein, 1113 aa, Human
WRPARAAVAQGRLLFWKLWLDQSLREMEVLKIIGALIMKKKVKEIQIKMGQICSVWMKMRILKPQKEKRQLNRRSEIVANSSGEFILKTYVRRNKSESFKTLKGNPIGLNMLSNNKKLSENTQNTSLCSGTVVHGRRFHHAHAQIPVVKTAAQSSLDRKERKEYPPHVQKVEINPVRLSRLQGVERIMKKTEESESQVEPEIKRKVQQKRHCSTYQPTPPLSPASKKCLTHLEDLQRNCRQAITLNESTGPLLRTSIHQNSGGQKSQNTGLTTKKFYGNNVEKVPIDIIVNCDDSKHTYLQTNGKVILPGAKIPKITNLKERKTSLSDLNDPIILSSDDDDDNDRTNRRESISPQPADSACSSPAPSTGKVEAALNENTCRAERELRSIPEDSELNTVTLPRKARMKDQFGNSIINTPLKRRKVFSQEPPDALALSCQSSFDSVILNCRSIRVGTLFRLLIEPVIFCLDFIKIQLDEPDHDPVEIILNTSDLTKCEWCNVRKLPVVFLQAIPAVYQKLSIQLQMNKEDKVWNDCKGVNKLTNLEEQYIILIFQNGLDPPANMVFESIINEIGIKNNISNFFAKIPFEEANGRLVACTRTYEESIKGSCGQKENKIKTVSFESKIQLRSKQEFQFFDEEEETGENHTIFIGPVEKLIVYPPPPAKGGISVTNEDLHCLNEGEFLNDVIIDFYLKYLVLEKLKKEDADRIHIFSSFFYKRLNQRERRNHETTNLSIQQKRHGRVKTWTRHVDIFEKDFIFVPLNEAAHWFLAVVCFPGLEKPKYEPNPHYHENAVIQKCSTVEDSCISSSASEMESCSQNSSAKPVIKKMLNKKHCIAVIDSNPGQEESDPRYKRNICSVKYSVKKINHTASENEEFNKGESTSQKVADRTKSENGLQNESLSSTHHTDGLSKIRLNYSDESPEAGKMLEDELVDFSEDQDNQDDSSDDGFLADDNCSSEIGQWHLKPTICKQPCILLMDSLRGPSRSNVVKILREYLEVEWEVKKGSKRSFSKDVMKGSNPKVPQQNNFSDCGVYVLQYVESFFENPILSFELPMNLANWFPPPRMRTKREEIRNIILKLQEDQSKEKRKHKDTYSTEAPLGEGTEQYVNSISD

SEQ ID NO: 9905 - protein, 608 aa, Human
GFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 9906 - protein, 149 aa, Human
QDKLSLEGIVVQRAECRPAASENYMRLKRLQIEESSKPVRLSQQLDKVVTTNYKPVANHQYNIEYERKKKEDGKRARADKQHVLDMLFSAFEKHQYYNLKDLVDITKQPVVYLKEILKEIGVQNVKGIHKNTWELKPEYRHYQGEEKSD

SEQ ID NO: 9907 - protein, 486 aa, Human
IAPVTCQRRAKGAFGVGFLEAAFSFTWKASLVMDPYMIQMSSKGNLPSILDVHVNVGGRSSVPGKMKGRKARWSVRPSDMAKKTFNPIRAIVDNMKVKPNPNKTMISLSIGDPTVFGNLPTDPEVTQAMKDALDSGKYNGYAPSIGFLSSREEIASYYHCPEAPLEAKDVILTSGCSQAIDLCLAVLANPGQNILVPRPGFSLYKTLAESMGIEVKLYNLLPEKSWEIDLKQLEYLIDEKTACLIVNNPSNPCGSVFSKRHLQKILAVAARQCVPILADEIYGDMVFSDCKYEPLATLSTDVPILSCGGLAKRWLVPGWRLGWILIHDRRDIFGNEIRDGLVKLSQRILGPCTIVQGALKSILCRTPGEFYHNTLSFLKSNADLCYGALAAIPGLRPVRPSGAMYLMVGIEMEHFPEFENDVEFTERLVAEQSVHCLPATCFEYPNFIRVVITVPEVMMLEACSRIQEFCEQHYHCAEGSQEECDK

SEQ ID NO: 9908 - protein, 3730 aa, Human
ELPSPVSGPPAPDQSHLRVLGPAGGLTMEGCDSPVVSGKDNGCGIPQHQQWTELNSTHLPDKPSSMEQSTGESHGPLDSLRAPFNERLAESTASAGPPSEPASKEVTCNECSASFASLQTYMEHHCPSARPPPPLREESASDTGEEGDEESDVENLAGEIVYQPDGSAYIVESLSQLTQGGGACGSGSGSGPLPSLFLNSLPGAGGKQGDPSCAAPVYPQIINTFHIASSFGKWFEGPDQAFPNTSALAGLSPVLHSFRVFDVRHKSNKDYLNSDGSAKSSCVSKDVPNNVDLSKFDGFVLYGKRKPILMCFLCKLSFGYVRSFVTHAVHDHRMTLSEDERKILSNKNISAIIQGIGKDKEPLVSFLEPKNKNFQHPLVSTANLIGPGHSFYGKFSGIRMEGEEALPAGSAAGPEQPQAGLLTPSTLLNLGGLTSSVLKTPITSVPLGPLASSPTKSSEGKDSGAAEGEKQEVGDGDCFSEKVEPAEEEAEEEEEEEEAEEEEEEEEEEEEEEEDEGCKGLFPSELDEELEDRPHEEPGAAAGSSSKKDLALSNQSISNSPLMPNVLQTLSRGTASTSSNSASSFVVFDGANRRNRLSFNSEGVRANVAEGGRRLDFADESANKDNATAPEPNESTEGDDGGFVPHHQHAGSLCELGVGECPSGSGVECPKCDTVLGSSRSLGGHMTMMHSRNSCKTLKCPKCNWHYKYQQTLEAHMKEKHPEPGGSCVYCKSGQPHPRLARGESYTCGYKPFRCEVCNYSTTTKGNLSIHMQSDKHLNNMQNLQNGGGEQVFSHTAGAAAAAVAAAAAAANISSSCGAPSPTKPKTKPTWRCEVCDYETNVARNLRIHMTSEKHMHNMMLLQQNMTQIQHNRHLGLGSLPSPAEAELYQYYLAQNMNLPNLKMDSAASDAQFMMSGFQLDPAGPMAAMTPALVGGEIPLDMRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIQQQQQRQLQQQQQQKVQQQQPKASQTPVPPGAPSPDKDPAKESPKPEEQKNTPREVSPLLPKLPEEPEAESKSADSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPPPSAAAPSSASPHASRKSWPQVVSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 9909 - protein, 350 aa, Human
KGTGDRYCCRCLRVAGSQAWRAGCVAMPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLEKVATGKLPINHQIIYQLQDVFNLLPDVSLQEFVKAFYLKTNDQMVVVYLASLIRSVVALHNLINNKIANRDAEKKEGQEKEESKKDRKEDKEKDKDKEKSDVKKEEKKEKK

SEQ ID NO: 9910 - protein, 381 aa, Human
SLWWRKGRPSPASCKSLMSRQQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 9911 - protein, 122 aa, Human
MKLLTGLVFCSLVLSVSSRSFFSFLGEAFDGARDMWRAYSDMREANYIGSDKYFHARGNYDAAKRGPGGAWAAEVISNARENIQRLTGHGAEDSLADQAANKWGRSGRDPNHFRPAGLPEKY

SEQ ID NO: 9912 - protein, 394 aa, Human
KKNMVEADRPGKLFIGGLNTETNEKALEAVFGKYGRIVEVLLMKDRETNKSRGFAFVTFESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 9913 - protein, 211 aa, Human
VRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGERSCRPCCRHPG

SEQ ID NO: 9914 - protein, 123 aa, Human
PSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 9915 - protein, 870 aa, Human
PEEALEPEAMAHYPTRLKTRKTYSWVGRPLLDRKLHYQTYREMCVKTEGCSTEIHIQIGQFVLIEGDDDENPYVAKLLELFEDDSDPPPKKRARVQWFVRFCEVPACKRHLLGRKPGAQEIFWYDYPACDSNINAETIIGLVRVIPLAPKDVVPTNLKNEKTLFVKLSWNEKKFRPLSSELFAELNKPQESAAKCQKPVRAKSKSAESPSWTPAEHVAKRIESRHSASKSRQTPTHPLTPRARKRLELGNLGNPQMSQQTSCASLDSPGRIKRKVAFSEITSPSKRSQPDKLQTLSPALKAPEKTRETGLSYTEDDKKASPEHRIILRTRIAASKTIDIREERTLTPISGGQRSSVVPSVILKPENIKKRDAKEAKAQNEATSTPHRIRRKSSVLTMNRIRQQLRFLGNSKSDQEEKEILPAAEISDSSSDEEEASTPPLPRRAPRTVSRNLRSSLKSSLHTLTKVPKKSLKPRTPRCAAPQIRSRSLAAQEPASVLEEARLRLHVSAVPESLPCREQEFQDIYNFVESKLLDHTGGCMYISGVPGTGKTATVHEVIRCLQQAAQANDVPPFQYIEVNGMKLTEPHQVYVQILQKLTGQKATANHAAELLAKQFCTRGSPQETTVLLVDELDLLWTHKQDIMYNLFDWPTHKEARLVVLAIANTMDLPERIMMNRVSSRLGLTRMCFQPYTYSQLQQILRSRLKHLKAFEDDAIQLVARKVAALSGDARRCLDICRRATEICEFSQQKPDSPGLVTIAHSMEAVDEMFSSSYITAIKNSSVLEQSFLRAILAEFRRSGLEEATFQQIYSQHVALCRMEGLPYPTMSETMAVCSHLGSCRLLLVEPSRNDLLLRVRLNVSQDDVLYALKDE

SEQ ID NO: 9916 - protein, 838 aa, Human
FSYGTDEYDGEGNEEQKGPPEGSETMPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 9917 - protein, 838 aa, Human; identical to SEQ ID NO: 9916

SEQ ID NO: 9918 - protein, 520 aa, Human
WMFETEADEKREMALEEGKGPGAEDSPPSKEPSPGQELPPGQDLPPNKDSPSGQEPAPSQEPLSSKDSATSEGSPPGPDAPPSKDVPPCQEPPPAQDLSPCQDLPAGQEPLPHQDPLLTKDLPAIQESPTRDLPPCQDLPPSQVSLPAKALTEDTMSSGDLLAATGDPPAAPRPAFVIPEVRLDSTYSQKAGAEQGCSGDEEDAEEAEEVEEGEEGEEDEDEDTSDDNYGERSEAKRSSMIETGQGAEGGLSLRVQNSLRRRTHSEGSLLQEPRGPCFASDTTLHCSDGEGAASTWGMPSPSTLKKELGRNGGSMHHLSLFFTGHRKMSGADTVGDDDEASRKRKSKNLAKDMKNKLGIFRRRNESPGAPPAGKADKMMKSFKPTSEEALKWGESLEKLLVHKYGLAVFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 9919 - protein, 380 aa, Human
AAAAERRAQRGGGGGGPAANMAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRS

SEQ ID NO: 9920 - protein, 207 aa, Human
QKSDDGFYFTHTPVCNKMPNSVSYPNKPPFVLVASLDPEMLPFLETVPLLRISANVALPACQPLTALCSSREDTCVPAAPQGLSALALAPQGWPRQQRLGFRASGCLSFGPGRLAPASHAFRVGSEQAGEQPWLLQNQKAGSSGGGASCGAATHCCPKLTQEFTPAWFLEVCWVLPSAPYSPPRQRIGFLRCCDPVLLPVIKMLSDT

SEQ ID NO: 9921 - protein, 145 aa, Human; identical to SEQ ID NO: 6787

SEQ ID NO: 9922 - protein, 477 aa, Human
CLETGWACLGRRRCRGFSFRPLHGGGCLTGSPSGMRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIGLYLWEHIFEGLLDPSDVTAQWREGKSIVGRTQYSFITGPAVIPGYFSVDVNNVVLILNGREKAKIFYATQWLLYAQNLVQIQKLQHLAVVLLGNEHCDNEWINPFLKRNGGFVELLFIIYDSPWINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 9923 - protein, 2176 aa, Human
GTMSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKKSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPPIKLPEECIYRQSWTVGKLELLSSGPSMPFIKEGDGSNMDQEYGTAYTPQTHTSFGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNFDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 9924 - protein, 820 aa, Human
AGTWEPRPCDQAKETGAPGSQPPVPPMELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 9925 - protein, 1004 aa, Human
YSCASAGIGAAGPWRGTLREELGTATLGEFFGVTFKMDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 9926 - protein, 798 aa, Human
LVAHWATEDPARMKKWSSTDLGAAADPLQKDTCPDPLDGDPNSRPPPAKPQLSTAKSRTRLFGKGDSEEAFPVDCPHEEGELDSCPTITVSPVITIQRPGDGPTGARLLSQDSVAASTEKTLRLYDRRSIFEAVAQNNCQDLESLLLFLQKSKKHLTDNEFKDPETGKTCLLKAMLNLHDGQNTTIPLLLEIARQTDSLKELVNASYTDSYYKGQTALHIAIERRNMALVTLLVENGADVQAAAHGDFFKKTKGRPGFYFGELPLSLAACTNQLGIVKFLLQNSWQTADISARDSVGNTVLHALVEVADNTADNTKFVTSMYNEILILGAKLHPTLKLEELTNKKGMTPLALAAGTGKIGVLAYILQREIQEPECRHLSRKFTEWAYGPVHSSLYDLSCIDTCEKNSVLEVIAYSSSETPPPFKMEKTGDYFRVTGEILSVLGGVYFFFRGIQYFLQRRPSMKTLFVDSYSEMLFFLQSLFMLATVVLYFSHLKEYVASMVFSLALGWTNMLYYTRGFQQMGIYAVMIEKMILRDLCRFMFVYIVFLFGFSTAVVTLIEDGKNDSLPSESTSHRWRGPACRPPDSSYNSLYSTCLELFKFTIGMGDLEFTENYDFKAVFIILLLAYVILTYILLLNMLIALMGETVNKIAQESKNIWKLQRAITILDTEKSFLKCMRKAFRSGKLLQVGYTPDGKDDYRWCFRVDEVNWTTWNTNVGIINEDPGNCEGVKRTLSFSLRSSRVSGRHWKNFALVPLLREASARDRQSAQPEEVYLRQFSGSLKPEDAEVFKSPAASGEK

SEQ ID NO: 9927 - protein, 570 aa, Human
RAGVLAWSSTCGALGLGGLGRAGNGRGGPEAAAADSPSLRGCDPEATGCRWEPAEPRMRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLRSQRVEGARTHPHCCCRSRC

SEQ ID NO: 9928 - protein, 570 aa, Human; identical to SEQ ID NO: 9927

SEQ ID NO: 9929 - protein, 570 aa, Human; identical to SEQ ID NO: 9927

SEQ ID NO: 9930 - protein, 570 aa, Human; identical to SEQ ID NO: 9927

SEQ ID NO: 9931 - protein, 570 aa, Human; identical to SEQ ID NO: 9927

SEQ ID NO: 9932 - protein, 570 aa, Human; identical to SEQ ID NO: 9927

SEQ ID NO: 9933 - protein, 587 aa, Human
VDPFTDYGSSLTVTLPPELQAHQPFQVILRYTSTDAPAIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 9934 - protein, 933 aa, Human [sequence omitted]

SEQ ID NO: 9935 - protein, 1123 aa, Human
YSPPGLGPGRQLRRAGVSGAMAGASVKVAVRVRPFNARETSQDAKCVVSMQGNTTSIINPKQSKDAPKSFTFDYSYWSHTSTEDPQFASQQQVYRDIGEEMLLHAFEGYNVCIFAYGQTGAGKSYTMMGRQEPGQQGIVPQLCEDLFSRVSENQSAQLSYSVEVSYMEIYCERVRDLLNPKSRGSLRVREHPILGPYVQDLSKLAVTSYADIADLMDCGNKARTVAATNMNETSSRSHAVFTIVFTQRCHDQLTGLDSEKVSKISLVDLAGSERADSSGARGMRLKEGANINKSLTTLGKVISALADMQSKKRKSDFIPYRDSVLTWLLKENLGGNSRTAMIAALSPADINYEETLSTLRYADRTKQIRCNAIINEDPNARLIRELQEEVARLRELLMAQGLSASALEGLKTEEGSVRGALPAVSSPPAPVSPSSPTTHNGELEPSFSPNTESQIGPEEAMERLQETEKIIAELNETWEEKLRKTEALRMEREALLAEMGVAVREDGGTVGVFSPKKTPHLVNLNEDPLMSECLLYHIKDGVTRVGQVDMDIKLTGQFIREQHCLFRSIPQPDGEVVVTLEPCEGAETYVNGKLVTEPLVLKSGNRIVMGKNHVFRFNHPEQARLERERGVPPPPGPPSEPVDWNFAQKELLEQQGIDIKLEMEKRLQDLENQYRKEKEEADLLLEQQRLYADSDSGDDSDKRSCEESWRLISSLREQLPPTTVQTIVKRCGLPSSGKRRAPRRVYQIPQRRRLQGKDPRWATMADLKMQAVKEICYEVALADFRHGRAEIEALAALKMRELCRTYGKPDGPGDAWRAVARDVWDTVGEEEGGGAGSGGGSEEGARGAEVEDLRAHIDKLTGILQEVKLQNSSKDRELQALRDRMLRMERVIPLAQDHEDENEEGGEVPWAPPEGSEAAEEAAPSDRMPSARPPSPPLSSWERVSRLMEEDPAFRRGRLRWLKQEQLRLQGLQGSGGRGGGLRRPPARFVPPHDCKLRFPFKSNPQHRESWPGMGSGEAPTPLQPPEEVTPHPATPARRPPSPRRSHHPRRNSLDGGGRSRGAGSAQPEPQHFQPKKHNSYPQPPQPYPAQRPPGPRYPPYTTPPRMRRQRSAPDLKESGAAV

SEQ ID NO: 9936 - protein, 182 aa, Human
EPRSGRQRVPRALRLPPPASRGSSSPVRGPSSSAESSPSSSAMAGWNAYIDNLMADGTCQDAAIVGYKDSPSVWAAVPGKTFVNITPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 9937 - protein, 200 aa, Human
HLTMCTGKCARCVGLSLITLCLVCIVANALLLVPNGETSWTNTNHLSLQVWLMGGFIGGGLMVLCPGIAAVRAGGKGCCGAGCCGNRCRMLRSVFSSAFGVLGAIYCLSVSGAGLRNGPRCLMNGEWGYHFEDTAGAYLLNRTLWDRCEAPPRVVPWNVTLFSLLVAASCLEIVLCGIQLVNATIGVFCGDCRKKQDTPH

SEQ ID NO: 9938 - protein, 448 aa, Human
RSREIETGSPSSQASNAESGLIFSTGSPFPEAGNTAHLAGSPTSLSSATLPEVFLSPVLGSVPFPRFIPVPEKDTFSASHPAPLNGTRGLLSLFPPAAMHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLLVPDNTFPLGYYLIPFTGIVGLLVLAMGAVMIARCIQHRKRLQRNRLTKEQLKQIPTHDYQKGDQYDVCAICLDEYEDGDKLRVLPCAHAYHSRCVDPWLTQTRKTCPICKQPVHRGPGDEDQEEETQGQEEGDEGEPRDHPASERTPLLGSSPTLPTSFGSLAPAPLVFPGPSTDPPLSPPSSPVILV

SEQ ID NO: 9939 - protein, 143 aa, Human
AHTESHFRNKRRVSEEKLLVRIPRVIMATYSLANERLRALEDIEREIGAILQNAGTVILELSKEKTNERLLDRQAAAFTASVQHVEAELSAQIRYLTQVATGQPHEGSSYSSRKDCQMALKRVDYARLKLSDVARTCEQMLEN

SEQ ID NO: 9940 - protein, 315 aa, Human
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTMRVPTRRCWE

SEQ ID NO: 9941 - protein, 408 aa, Human [sequence omitted]

SEQ ID NO: 9942 - protein, 1435 aa, Human
TSLLSGVSSPMENYFQAEAYNLDKVLDEFEQNEDETVSSTLLDTKWNKILDPPSHRLSFNPTLASVNESAVSNESQPQLKVFSLAHSAPLTTEEEDHCANGQDCNLNPEIATMWIDENAVAEDQLIKRNYSWDDQCSAVEVGEKKCGNLACLPDEKNVLVVAVMHNCDKRTLQNDLQDCNNYNSQSLMDAFSCSLDNENRQTDQFSFSINESTEKDMNSEKQMDPLNRPKTEGRSVNHLCPTSSDSLASVCSPSQLKDDGSIGRDPSMSAITSLTVDSVISSQGTDGCPAVKKQENYIPDEDLTGKISSPRTDLGSPNSFSHMSEGILMKKEPAEESTTEESLRSGLPLLLKPDMPNGSGRNNDCERCSDCLVPNEVRADENEGYEHEETLGTTEFLNMTEHFSESQDMTNWKLTKLNEMNDSQVNEEKEKFLQISQPEDTNGDSGGQCVGLADAGLDLKGTCISESEECDFSTVIDTPAANYLSNGCDSYGMQDPGVSFVPKTLPSKEDSVTEEKEIEESKSECYSNIYEQRGNEATEGSGLLLNSTGDLMKKNYLHNFCSQVPSVLGQSSPKVVASLPSISVPFGGARPKQPSNLKLQIPKPLSDHLQNDFPANSGNNTKNKNDILGKAKLGENSATNVCSPSLGNISNVDTNGEHLESYEAEISTRPCLALAPDSPDNDLRAGQFGISARKPFTTLGEVAPVWVPDSQAPNCMKCEARFTFTKRRHHCRACGKVFCASCCSLKCKLLYMDRKEARVCVICHSVLMNAQAWENMMSASSQSPNPNNPAEYCSTIPPLQQAQASGALSSPPPTVMVPVGVLKHPGAEVAQPREQRRVWFADGILPNGEVADAAKLTMNGTSSAGTLAVSHDPVKPVTTSPLPAETDICLFSGSITQVGSPVGSAMNLIPEDGLPPILISTGVKGDYAVEEKPSQISVMQQLEDGGPDPLVFVLNANLLSMVKIVNYVNRKCWCFTTKGMHAVGQSEIVILLQCLPDEKCLPKDIFNHFVQLYRDALAGNVVSNLGHSFFSQSFLGSKEHGGFLYVTSTYQSLQDLVLPTPPYLFGILIQKWETPWAKVFPIRLMLRLGAEYRLYPCPLFSVRFRKPLFGETGHTIMNLLADFRNYQYTLPVVQGLVVDMEVRKTSIKIPSNRYNEMMKAMNKSNEHVLAGGACFNEKADSHLVCVQNDDGNYQTQAISIHNQPRKVTGASFFVFSGALKSSSGYLAKSSIVEDGVMVQITAENMDSLRQALREMKDFTITCGKADAEEPQEHIHIQWVDDDKNVSKGVVSPIDGKSMETITNVKIFHGSEYKANGKVIRWTEVFFLENDDQHNCLSDPADHSRLTEHVAKAFCLALCPHLKLLKEDGMTKLGLRVTLDSDQVGYQAGSNGQPLPSQYMNDLDSALVPVIHGGACQLSEGPVVMELIFYILENIV

SEQ ID NO: 9943 - protein, 1435 aa, Human; identical to SEQ ID NO: 9942

SEQ ID NO: 9944 - protein, 1435 aa, Human; identical to SEQ ID NO: 9942

SEQ ID NO: 9945 - protein, 945 aa, Human
ATARSGLVVQITGKFEGLGPTVIVCPTTVMHQWVKEFHTWWPPFRVAILHETGSYTHKKEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 9946 - protein, 415 aa, Human
PHLCIPAPGLTKTPILEKVPRKMAAKTPSSEESGLPKLPVPPLQQTLATYLQCMRHLVSEEQFRKSQAIVQQFGAPGGLGETLQQKLLERQEKTANWVSEYWLNDMYLNNRLALPVNSSPAVIFARQHFPGTDDQLRFAASLISGVLSYKALLDSHSIPTDCAKGQLSGQPLCMKQYYGLFSSYRLPGHTQDTLVAQNSSIMPEPEHVIVACCNQFFVLDVVINFRRLSEGDLFTQLRKIVKMASNEDERLPPIGLLTSDGRSEWAEARTVLVKDSTNRDSLDMIERCICLVCLDAPGGVELSDTHRALQLLHGGGYSKNGANRWYDKSLQFVVGRDGTCGVVCEHSPFDGIVLVQCTEHLLKHIIVKNLDFIVYKFDNYGKTFIKKQKCSPDAFIQVALQLAFYSYTGHNRDGH

SEQ ID NO: 9947 - protein, 415 aa, Human; identical to SEQ ID NO: 9946

SEQ ID NO: 9948 - protein, 415 aa, Human; identical to SEQ ID NO: 9946

SEQ ID NO: 9949 - protein, 415 aa, Human; identical to SEQ ID NO: 9946

SEQ ID NO: 9950 - protein, 455 aa, Human
RVFFFFLDAEMNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLNYTPADYGGLHHAAARISGDGVYKHLKYEGGIHRVQRIPEVGLSSRMQRIHTGTMSVIVLPQPDEVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKEFLCGGKGLDQLIQRLLQSADEEAIAELLDEHLKSAK

SEQ ID NO: 9951 - protein, 389 aa, Human
VEPWTTCRAAGAVMADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKEKKKRKKDPSKGRWVEGITSEGYHYYYDLISGASQWEKPEGFQGDLKKTAVKTVWVEGLSEDGFTYYYNTETGESRWEKPDDFIPHTSDLPSSKVNENSLGTLDESKSSDSHSDSDGEQEAEEGGVSTETEKPKIKFKEKNKNSDGGSDPETQKEKSIQKQNSLGSNEEKSKTLKKSNPYGEWQEIKQEVESHEEVDLELPSTENEYVSTSEADGGGEPKVVFKEKTVTSLGVMADGVAPVFKKRRTENGKSRNLRQRGDDQ

SEQ ID NO: 9952 - protein, 333 aa, Human
AGRGHAGAAGYVVPVISSRELPSTRPAEEWANMKSNPAIQAAIDLTAGAAGGTACVLTGQPFDTMKVKMQTFPDLYRGLTDCCLKTYSQVGFRGFYKGTSPALIANIAENSVLFMCYGFCQQVVRKVAGLDKQAKLSDLQNAAAGSFASAFAALVLCPTELVKCRLQTMYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 9953 - protein, 724 aa, Human [sequence omitted]

SEQ ID NO: 9954 - protein, 316 aa, Human
GAVVSFFLISFFKGKKFECIAMEKMSRPLPLNPTFIPPPYGVLRSLLENPLKLPLHHEDAFSKDKDKEKKLDDESNSPTVPQSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 9955 - protein, 88 aa, Human
ATMPQYQTWEEFSRAAEKLYLADPMKARVVLKYRHSDGNLCVKVTDDLVCLVYKTDQAQDVKKIEKFHSQLMRLMVAKEARNVTMETE

SEQ ID NO: 9956 - protein, 616 aa, Human
KMPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFNLSQESSYIATQYSLRPRREEVKLKEIDSKEEKYVAKELAVRTFEVTPIRAKDLEFGGVPGVFLIMFGLPVFLFLLLLMCKQKDPSLLNFPPPLPALYELWETRVFGVYLLWFLIQVLFYLLPIGKVVEGTPLIDGRRLKYRLNGFYAFILTSAVIGTSLFQGVEFHYVYSHFLQFALAATVFCVVLSVYLYMRSLKAPRNDLSPASSGNAVYDFFIGRELNPRIGTFDLKYFCELRPGLIGWVVINLVMLLAEMKIQDRAVPSLAMILVNSFQLLYVVDALWNEEALLTTMDIIHDGFGFMLAFGDLVWVPFIYSFQAFYLVSHPNEVSWPMASLIIVLKLCGYVIFRGANSQKNAFRKNPSDPKLAHLKTIHTSTGKNLLVSGWWGFVRHPNYLGDLIMALAWSLPCGFNHILPYFYIIYFTMLLVHREARDEYHCKKKYGVAWEKYCQRVPYRIFPYIY

SEQ ID NO: 9957 - protein, 182 aa, Human
RRRRLPSVAIMIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 9958 - protein, 276 aa, Human
MHAPGMKKIKLDTPEEIARWREERRKNYPTLANIERKKKLKLEKEKRGAVLTTTQYGKMKGMSRHSQMAKIRSPGKNHKWKNDNSRQRAVTGSGSHLCDLKLEGPPEANADPLGVLINSDSESDKEEKPQHSVIPKEVTPALCSLMSSYGSLSGSESEPEETPIKTEADVLAENQVLDSSAPKSPSQDVKATVRNFSEAKSENRKKSFEKTNPKRKKDYHNYQTLFEPRTHHPYLLEMLLAPDIRHERNVILQCVRYIIKKDFFGLDTNSAKSKDV

SEQ ID NO: 9959 - protein, 1346 aa, Human
RQDIFMFITRQLKGLEDTKSPQFNRYFYLLENIAWVKSYNICFELEDSNEIFTQLYRTLFSVINNGHNQKVHMHMVDLMSSIICEGDTVSQELLDTVLVNLVPAHKNLNKQAYDLAKALLKRTAQAIEPYITNFFNQVLMLGKTSISDLSEHVFDLILELYNIDSHLLLSVLPQLEFKLKSNDNEERLQVVKLLAKMFGAKDSELASQNKPLWQCYLGRFNDIHVPIRLECVKFASHCLMNHPDLAKDLTEYLKVRSHDPEEAIRHDVIVSIVTAAKKDILLVNDHLLNFVRERTLDKRWRVRKEAMMGLAQIYKKYALQSAAGKDAAKQIAWIKDKLLHIYYQNSIDDRLLVERIFAQYMVPHNLETTERMKCLYYLYATLDLNAVKALNEMWKCQNLLRHQVKDLLDLIKQPKTDASVKAIFSKVMVITRNLPDPGKAQDFMKKFTQVLEDDEKIRKQLEVLVSPTCSCKQAEGCVREITKKLGNPKQPTNPFLEMIKFLLERIAPVHIDTESISALIKQVNKSIDGTADDEDEGVPTDQAIRAGLELLKVLSFTHPISFHSAETFESLLACLKMDDEKVAEAALQIFKNTGSKIEEDFPHIRSALLPVLHHKSKKGPPRQAKYAIHCIHAIFSSKETQFAQIFEPLHKSLDPSNLEHLITPLVTIGHIALLAPDQFAAPLKSLVATFIVKDLLMNDRLPGKKTTKLWVPDEEVSPETMVKIQAIKMMVRWLLGMKNNHSKSGTSTLRLLTTILHSDGDLTEQGKISKPDMSRLRLAAGSAIVKLAQEPCYHEIITLEQYQLCALAINDECYQVRQVFAQKLHKGLSRLRLPLEYMAICALCAKDPVKERRAHARQCLVKNINVRREYLKQHAAVSEKLLSLLPEYVVPYTIHLLAHDPDYVKVQDIEQLKDVKECLWFVLEILMAKNENNSHAFIRKMVENIKQTKDAQGPDDAKMNEKLYTVCDVAMNIIMSKSTTYSLESPKDPVLPARFFTQPDKNFSNTKNYLPPEMKSFFTPGKPKTTNVLGAVNKPLSSAGKQSQTKSSRMETVSNASSSSNPSSPGRIKGRLDSSEMDHSENEDYTMSSPLPGKKSDKRDDSDLVRSELEKPRGRKKTPVTEQEEKLGMDDLTKLVQEQKPKGSQRSRKRGHTASESDEQQWPEEKRLKEDILENEDEQNSPPKKGKRGRPPKPLGGGTPKEEPTMKTSKKGSKKKSGPPAPEEEEEEERQSGNTEQKSKSKQHRVSRRAQQSRAESPESSAIESTQSTPQKGRGRPSKTPSPSQPKKNVRVGRSKQAATKENDSSEEVDVFQGSSPVDDIPQEETEEEEVSTVNVRRRSAKRERR

SEQ ID NO: 9960 - protein, 448 aa, Human
CREGLCGSRARRSLLWPLMHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 9961 - protein, 272 aa, Human
KARPPPAQPLAQRLCSMVCFSLLALSFNILLLVVICVTGSQSEGHRGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 9962 - protein, 311 aa, Human
RTWESDPETLSNPRSSASPIMTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 9963 - protein, 395 aa, Human
KDNDGKSGARFGVQAGFGASCLVGGGRSAGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 9964 - protein, 610 aa, Human
PQLATTQPSPVRISLKMAAESGELIGACEFMKDRLYFATLRNRPKSTVNTHYFSIDEELVYENFYADFGPLNLAMVYRYCCKLNKKLKSYSLSRKKIVHYTCFDQRKRANAAFLIGAYAVIYLKKTPEEAYRALLSGSNPPYLPFRDASFGNCTYNLTILDCLQGIRKGLQHGFFDFETFDVDEYEHYERVENGDFNWIVPGKFLAFSGPHPKSKIENGYPLHAPEAYFPYFKKHNVTAVVRLNKKIYEAKRFTDAGFEHYDLFFIDGSTPSDNIVRRFLNICENTEGAIAVHCKAGLGRTGTLIACYVMKHYRFTHAEIIAWIRICRPGSIIGPQQHFLEEKQASLWVQGDIFRSKLKNRPSSEGSINKILSGLDDMSIGGNLSKTQNMERFGEDNLEDDDVEMKNGITQGDKLRALKSQRQPRTSPSCAFRSDDTKGHPRAVSQPFRLSSSLQGSAVTLKTSKMALSPSATAKRINRTSLSSGATVRSFSINSRLASSLGNLNAATDDPENKKTSSSSKAGFTASPFTNLLNGSSQPTTRNYPELNNNQYNRSSNSNGGNLNSPPGPHSAKTEEHTTILRPSYTGLSSSSARFLSRSIPSLQSEYVHY

SEQ ID NO: 9965 - protein, 198 aa, Human
MDAILNYRSEDTEDYYTLLGCDELSSVEQILAEFKVRALECHPDKHPENPKAVETFQKLQKAKEILTNEESRARYDHWRRSQMSMPFQQWEALNDSVKTSMHWVVRGKKDLMLEESDKTHTTKMENEECNEQRERKKEELASTAEKTEQKEPKPLEKSVSPQNSDSSGFADVNGWHLRFRWSKDAPSELLRKFRNYEI

SEQ ID NO: 9966 - protein, 272 aa, Human
NLYLKTFLNRYIEIFRSSRSEIKGFYDPPRRLLGQRPGPYDRPIGGRGGYYGAGRGSMYDRMRRGGDGYDGGYGGFDDYGGYNNYGYGNDGFDDRMRDGRGMGGHGYGGAGDASSGFHGGHFVHMRGLPFRATENDIANFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 9967 - protein, 272 aa, Human; identical to SEQ ID NO: 9966

SEQ ID NO: 9968 - protein, 232 aa, Human
LQNSELLFLCGQLGTSIMKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLS

SEQ ID NO: 9969 - protein, 243 aa, Human
SSWSWCTGRMRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 9970 - protein, 2596 aa, Human
VGLLGIQMLWTHDSEEALRNAKDDRKIMQVTNQKFLDILNTLISQTTHDLSKFDRVKFETLITIHVHQRDIFDDLNPGYAGRQELPENLKIQFRTVAMMVPDRQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGKTRNVYNDVFGLTINNPFLLLIKGVSWNTVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISILRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 9971 - protein, 582 aa, Human
CVPTISFSAGQAAVKGHHLFAFSKMAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLLKNMVLSLASELRENHLNGFNTQRRMAPERVASLSRVCVPLITLTDVDPLVEALLICHGREPQEILQPEFFEAVNEAILLKKISLPMSAVVCLWLRHLPSLEKAMLHLFEKLISSERNCLRRIECFIKDSSLPQAACHPAIFRVVDEMFRCALLETDGALEIIATIQVFTQCFVEALEKASKQLRFALKTYFPYTSPSLAMVLLQDPQDIPRGHWLQTLKHISELLREAVEDQTHGSCGGPFESWFLFIHFGGWAEMVAEQLLMSAAEPPTALLWLLAFYYGPRDGRQQRAQTMVQVKAVLGHLLAMSRSSSLSAQDLQTVAGQGTDTDLRAPAQQLIRHLLLNFLLWAPGGHTIAWDVITLMAHTAEITHEIIGFLDQTLYRWNRLGIESPRSEKLARELLKELRTQV

SEQ ID NO: 9972 - protein, 465 aa, Human
SSLSRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 9973 - protein, 805 aa, Human
PGNPMWTSGRMSNAKNWLGLGMSLYFWGLMDLTTTVLSDTPTPQGELEALLSDKPQSHQRTKRSWVWNQFFVLEEYTGTDPLYVGKLHSDMDRGDGSIKYILSGEGAGIVFTIDDTTGDIHAIQRLDREERAQYTLRAQALDRRTGRPMEPESEFIIKIQDINDNEPKFLDGPYVATVPEMSPVGTSVIQVTATDADDPTYGNSARVVYSILQGQPYFSVDSKTGVIRTALMNMDREAKEYYEVIIQAKDMGGQLGGLAGTTTVNITLSDVNDNPPRFPQKHYQMSVLESAPISSTVGRVFAKDLDEGINAEMKYTIVDGDGADAFDISTDPNFQVGIITVKKPLSFESKKSYTLKVEGANPHLEMRFLNLGPFQDTTTVHISVEDVDEPPVFEPGFYFVEVPEDVAIGTTIQIISAKDPDVTNNSIRYSIDRSSDPGRFFYVDITTGALMTARPLDREEFSWHNITVLAMEMNNPSQVGSVPVTIKVLDVNDNAPEFPRFYEAFVCENAKAGQLIQTVSAVDQDDPRNGQHFYYSLAPEAANNPNFTIRDNQDNTARILTRRSGFRQQEQSVFHLPILIADSGQPVLSSTGTLTIQVCSCDDDGHVMSCSPEAYMLPVSLSRGALIAILACIFVLLVLVLLILSMRRHRKQPYIIDDEENIHENIVRYDDEGGGEEDTEAFDIAAMWNPREAQAGAAPKTRQDMLPEIESLSRYVPQTCAVNSTVHSYVLAKLYEADMDLWAPPFDSLQTYMFEGDGSVAGSLSSLQSATSDSEQSFDFLTDWGPRFRKLAELYGASEGPAPLW

SEQ ID NO: 9974 - protein, 809 aa, Human
ANWNCAFSLVKVFFLHRKKKEKKKMKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTSTLTIRVCDCDADGVAQTCNAEAYVLPAGLSTGALIAILACVLTLLVLILLIVTMRRRKKEPLIFDEERDIRENIVRYDDEGGGEEDTEAFDMAALRNLNVIRDTKTRRDVTPEIQFLSRPAFKSIPDNVIFREFIWERLKEADVDPGAPPYDSLQTYAFEGNGSVAESLSSLDSISSNSDQNYDYLSDWGPRFKRLADMYGTGQESLYS

SEQ ID NO: 9975 - protein, 334 aa, Human
VALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDVVCSSSLPARKPPNGCRNPPGEDCEPLVGSPKRGPLPQCAYGMGLPPEEEASRTEARDQPEDGADGRLPSSARAGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 9976 - protein, 745 aa, Human
SWAKMAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 9977 - protein, 601 aa, Human
SHLLRTMKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKNSGMRTKYRTKKGHVTRKLTCLCIAYSSTIGGLTTITGTSTNLIFAEYFNTRYPDCRCLNFGSWFTFSFPAALIILLLSWIWLQWLFLGFNFKEMFKCGKTKTVQQKACAEVIKQEYQKLGPIRYQEIVTLVLFIIMALLWFSRDPGFVPGWSALFSEYPGFATDSTVALLIGLLFFLIPAKTLTKTTPTGEIVAFDYSPLITWKEFQSFMPWDIAILVGGGFALADGCEESGLSKWIGNKLSPLGSLPAWLIILISSLMVTSLTEVASNPATITLFLPILSPLAEAIHVNPLYILIPSTLCTSFAFLLPVANPPNAIVFSYGHLKVIDMVKAGLGVNIVGVAVVMLGICTWIVPMFDLYTYPSWAPAMSNETMP

SEQ ID NO: 9978 - protein, 581 aa, Human
PGRAGAGSFPFSARREGGSPSAPASLDLVLLPAPEELRDVAPLTPLLPAPVTERGNELSPTRRRRRPWTPNPAGETMSSVQQQPPPPRRVTNVGSLLLTPQENESLFTFLGKKCVTMSSAVVQLYAADRNCMWSKKCSGVACLVKDNPQRSYFLRIFDIKDGKLLWEQELYNNFVYNSPRGYFHTFAGDTCQVALNFANEEEAKKFRKAVTDLLGRRQRKSEKRRDPPNGPNLPMATVDIKNPEITTNRFYGPQVNNISHTKEKKKGKAKKKRLTKADIGTPSNFQHIGHVGWDPNTGFDLNNLDPELKNLFDMCGISEAQLKDRETSKVIYDFIEKTGGVEAVKNELRRQAPPPPPPSRGGPPPPPPPPHNSGPPPPPARGRGAPPPPPSRAPTAAPPPPPPSRPSVAVPPPPPNRMYPPPPPALPSSAPSGPPPPPPSVLGVGPVAPPPPPPPPPPPGPPPPPGLPSDGDHQVPTTAGNKAALLDQIREGAQLKKVEQNSRPVSCSGRDALLDQIRQGIQLKSVADGQESTPPTPAPTSGIVGALMEVMQKRSKAIHSSDEDEDEDDEEDFEDDDEWED

SEQ ID NO: 9979 - protein, 514 aa, Human
SLLFTMGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 9980 - protein, 205 aa, Human
SVRSPSAGSSGAGTVAASGTASAWGTTGSTCSQGGRAPHRHILGEHTQCLPSFSNSLFKHTHTRARAHTHSSSFFQSPTTAKLQKKLLDPFHYVHEKQQSKITEEAPESLSVCPHKTAEPSATPPTGVLSLRMTQIPEHRFKCNPCICMGHSHLNSRQAESVAGERVLTFNILPFTFSKHHEDAIDKVFLCKMNCSGFSKLDSWL

SEQ ID NO: 9981 - protein, 205 aa, Human; identical to SEQ ID NO: 9980

SEQ ID NO: 9982 - protein, 205 aa, Human; identical to SEQ ID NO: 9980

SEQ ID NO: 9983 - protein, 713 aa, Human
MYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 9984 - protein, 638 aa, Human
RPFWSAGGWATQGCPRRRMSGSWWKSQASDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVENWDNKSYMTDIGIYNMPSYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLKLLRYSNTTTLASWVRADWMFYSSHPALFLSTYLGHGLLIDYFEKKRRRNNNNDEVNANNLEWLSSLWDWYTSYLFHPIASFQNFPVESDWDEDPDLFLERLAFPDLWLHPLIPTDYIKNLPMWRFKCLGVQSEEEMSEGSQDTENDSESENTDTLSSEKEVFEDKQSVLHNSPGTASHCDAEACSCANKYCQTSPCERKGRSYGSYNTNEDMEPDWLTWPADMLHCTECVVCLENFENGCLLMGLPCGHVFHQNCIVMWLAGGRHCCPVCRWPSYKKKQPYAQHQPLSNDVPS

SEQ ID NO: 9985 - protein, 134 aa, Human
RGSSIATMSFSGKYQLQSQENFEAFMKAIGLPEELIQKGKDIKGVSEIVQNGKHFKFTITAGSKVIQNEFTVGEECELETMTGEKVKTVVQLEGDNKLVTTFKNIKSVTELNGDIITNTMTLGDIVFKRISKRI

SEQ ID NO: 9986 - protein, 158 aa, Human
ESRGCARFMSAKDERAREILRGFKLNWMNLRDAETGKILWQGTEDLSVPGVEHEARVPKKILKCKAVSRELNFSSTEQMEKFRLEQKVYFKGQCLEEWFFEFGFVIPNSTNTWQSLIEAAPESQMMPASVLTGNVIIETKFFDDDLLVSTSRVRLFYV

SEQ ID NO: 9987 - protein, 285 aa, Human
PVCTALTPGRMTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 9988 - protein, 176 aa, Human
GAEGARGGGSSYSEMAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQLPFRGDDGIFDDNFIEERKQGLEQFINKVAGHPLAQNERCLHMFLQDEIIDKSYTPSKIRHA

SEQ ID NO: 9989 - protein, 383 aa, Human
SWHQLKKSNPVNRRRGPGGSEPEKSTTNWRRTGRAHLKECFETLKRNIPNVDDKKTSNLSVLRTALRYIQSLKRKEKEYEHEMERLAREKIATQQRLAELKHELSQWMDVLEIDRVLRQTGQPEDDQASTSTASEGEDNIDEDMEEDRAGLGPPKLSHRPQPELLKSTLPPPSTTPAPLPPHPHPHPHSVALPPAHLPVQQQQPQQKTPLPAPPPPPAAPAQTLVPAPAHLVATAGGGSTVIAHTATTHASVIQTVNHVLQGPGGKHIAHIAPSAPSPAVQLAPATPPIGHITVHPATLNHVAHLGSQLPLYPQPVAVSHIAHTLSHQQVNGTAGLGPPATVMAKPAVGAQVVHHPQLVGQTVLNPVTMVTMPSFPVSTLKLA

SEQ ID NO: 9990 - protein, 1285 aa, Human; identical to SEQ ID NO: 6576

SEQ ID NO: 9991 - protein, 1256 aa, Human
ARGGSAGAPESGTEGSQESRLVREIPDPVMGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 9992 - protein, 938 aa, Human
FQGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGKTNWTNW

SEQ ID NO: 9993 - protein, 430 aa, Human
GGAAMAHLRGFANQHSRVDPEELFTKLDRIGKGSFGEVYKGIDNHTKEVVAIKIIDLEEAEDEIEDIQQEITVLSQCDSPYITRYFGSYLKSTKLWIIMEYLGGGSALDLLKPGPLEETYIATILREILKGLDYLHSERKIHRDIKAANVLLSEQGDVKLADFGVAGQLTDTQIKRNTFVGTPFWMAPEVIKQSAYDFKADIWSLGITAIELAKGEPPNSDLHPMRVLFLIPKNSPPTLEGQHSKPFKEFVEACLNKDPRFRPTAKELLKHKFITRYTKKTSFLTELIDRYKRWKSEGHGEESSSEDSDIDGEAEDGEQGPIWTFPPTIRPSPHSKLHKGTALHSSQKPAEPVKRQPRSQCLSTLVRPVFGELKEKHKQSGGSVGALEELENAFSLAEESCPGISDKLMVHLVERVQRFSHNRNHLTSTR

SEQ ID NO: 9994 - protein, 364 aa, Human
RAANMAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 9995 - protein, 559 aa, Human
CGGQRERHPEAPGVCTPAARGNAQRNYSDTETEGEIFNSLVQYFGDNLGRKVKAMPLVEETSLLEDSSVTFPVVIIGNGPSGICLSYMLSGYRPYLSSEAIHPNTILNSKLEEARHLSIVDQDLEYLSEGLEGRSSNPVAVLFDTLLHPDADFGYDYPSVLHWKLEQHHYIPHVVLGKGPPGGAWHNMEGSMLTISFGSWMELPGLKFKDWVSSKRRSLKGDRVMPEEIARYYKHYVKVMGLQKNFRENTYITSVSRLYRDQDDDDIQDRDISTKHLQIEKSNFIKRNWEIRGYQRIADGSHVPFCLFAENVALATGTLDSPAHLEIEGEDFPFVFHSMPEFGAAINKGKLRGKVDPVLIVGSGLTAADAVLCAYNSNIPVIHVFRRRVTDPSLIFKQLPKKLYPEYHKVYHMMCTQSYSVDSNLLSDYTSFPEHRVLSFKSDMKCVLQSVSGLKKIFKLSAAVVLIGSHPNLSFLKDQGCYLGHKSSQPITCKGNPVEIDTYTYECIKEANLFALGPLVGDNFVRFLKGGALGVTRCLATRQKKKHLFVERGGGDGIA

SEQ ID NO: 9996 - protein, 367 aa, Human
AAFPAPRTLFFLSRPLRPTACAAFRPEFWRLNMKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 9997 - protein, 857 aa, Human
DSKAAQDLEKLHGVNGMSVDEKPDSPMYVYESTVHCTNILLGLNDQRKKDILCDVTLIVERKEFRAHRAVLAACSEYFWQALVGQTKNDLVVSLPEEVTARGFGPLLQFAYTAKLLLSRENIREVIRCAEFLRMHNLEDSCFSFLQTQLLNSEDGLFVCRKDAACQRPHEDCENSAGEEEDEEEETMDSETAKMACPRDQMLPEPISFEAAAIPVAEKEEALLPEPDVPTDTKESSEKDALTQYPRYKKYQLACTKNVYNASSHSTSGFASTFREDNSSNSLKPGLARGQIKSEPPSEENEEESITLCLSGDEPDAKDRAGDVEMDRKQPSPAPTPTAPAGAACLERSRSVASPSCLRSLFSITKSVELSGLPSTSQQHFARSPACPFDKGITQGDLKTDYTPFTGNYGQPHVGQKEVSNFTMGSPLRGPGLEALCKQEGELDRRSVIFSSSACDQVSTSVHSYSGVSSLDKDLSEPVPKGLWVGAGQSLPSSQAYSHGGLMADHLPGRMRPNTSCPVPIKVCPRSPPLETRTRTSSSCSSYSYAEDGSGGSPCSLPLCEFSSSPCSQGARFLATEHQEPGLMGDGMYNQVRPQIKCEQSYGTNSSDESGSFSEADSESCPVQDRGQEVKLPFPVDQITDLPRNDFQMMIKMHKLTSEQLEFIHDVRRRSKNRIAAQRCRKRKLDCIQNLECEIRKLVCEKEKLLSERNQLKACMGELLDNFSCLSQEVCRDIQSPEQIQALHRYCPVLRPMDLPTASSINPAPLGAEQNIAASQCAVGENVPCCLEPGAAPPGPPWAPSNTSENCTSGRRLEGTDPGTFSERGPPLEPRSQTVTVDFCQEMTDKCTTDEQPRKDYT

SEQ ID NO: 9998 - protein, 219 aa, Human
PMEINPEMLNKVLSRLGVAGQWRFVDVLGLEEESLGSVPAPACALLLLFPLTAQHENFRKKQIEELKGQEVSPKVYFMKQTIGNSCGTIGLIHAVANNQDKLGFEDGSVLKQFLSETEKMSPEDRAKCFEKNEAIQAAHDAVAQEGQCRVDDKVNFHFILFNNVDGHLYELDGRMPFPVNHGASSEDTLLKDAAKVCREFTEREQGEVRFSAVALCKAA

SEQ ID NO: 9999 - protein, 306 aa, Human
NHIQPLPNTSYLPHIQPGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 10000 - protein, 386 aa, Human
CHSDVQVYWDLPWNLQWIFCNGCCYWSGDSSYVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 10001 - protein, 678 aa, Human
PLLHKALPSCDQLRTSGCSGAMPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETISGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRPWIKDRFMAPDIEAAHRLLLEQKVWEVAAPYIEKYRMEHIPESRPLSPTAFSLQFLHKKSTKIPESEDL

SEQ ID NO: 10002 - protein, 483 aa, Human
SPRAMPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITV

SEQ ID NO: 10003 - protein, 328 aa, Human
FFKPHSIDRMKKFKRRLSLTLRGSQTIDESLSELAEQMTIEENSSKDNEPIVKNGRPPTSHSMHSFLHQYTGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPMSRRSRRASLSEIGFGKMETYIKLEKLGEVRTPSQETWPGISSNEEFKNYNFPKYKPQPLINHAPRLDSEGIELITKFLQYESKKRVSAEEAMKHVYFRSLGPRIHALPESVSIFSLKEIQLQKDPGFRNSSYPETGHGKNRRQSMLF

SEQ ID NO: 10004 - protein, 255 aa, Human
FPANDAGAAGAAGAARSPRPQAHTKGVRGLPSRRRSPDCGRMELAAGSFSEEQFWEACAELQQPALAGADWQLLVETSGISIYRLLDKKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 10005 - protein, 139 aa, Human
NPSSDPQSTALNTSCKKPRERSAMDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 10006 - protein, 406 aa, Human
ASSQRKQLALTAWGQQGCSLPGEDALGGGKPGWRGLSDPLHRRAGQWERWCVDTSVSRPGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWGHLPPQPNSLDSGLLCLPCPSSHCPLASLSGSQALLWPGCPLLYGLE

SEQ ID NO: 10007 - protein, 453 aa, Human
PLAPVLWLHLHRPALPKGPGSPQKLYHRRGWWHPAHPESRGRAGGSVLSPSRPTMARRFQEELAAFLFEYDTPRMVLVRNKKVGVIFRLIQLVVLVYVIGWVFLYEKGYQTSSGLISSVSVKLKGLAVTQLPGLGPQVWDVADYVFPAQGDNSFVVMTNFIVTPKQTQGYCAEHPEGGICKEDSGCTPGKAKRKAQGIRTGKCVAFNDTVKTCEIFGWCPVEVDDDIPRPALLREAENFTLFIKNSISFPRFKVNRRNLVEEVNAAHMKTCLFHKTLHPLCPVFQLGYVVQESGQNFSTLAEKGGVVGITIDWHCDLDWHVRHCRPIYEFHGLYEEKNLSPGFNFRFARHFVENGTNYRHLFKVFGIRFDILVDGKAGKFDIIPTMTTIGSGIGIFGVATVLCDLLLLHILPKRHYYKQKKFKYAEDMGPGAAERDLAATSSTLGLQENMRTS

SEQ ID NO: 10008 - protein, 383 aa, Human
ELARRPKQQSSEKSRNMIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVITWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGYDQLN

SEQ ID NO: 10009 - protein, 433 aa, Human
PGGPQARLRARHGAGGLQGALPVAVRLQDREVCHRQEQEGGPAVPAAAGLHPGVPGRMGVPDKEGLPRRRHLPAECCHHQSQGRGLHQHLGSWAADLGCRRLRHSSPGRERLFCGHQPDCDPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 10010 - protein, 170 aa, Human
MTELQSALLLRRQLAELNKNPVEGFSAGLIDDNDLYRWEVLIIGPPDTLYEGGVFKAHLTFPKDYPLRPPKMKFITEIWHPNVDKNGDVCISILHEPGEDKYGYEKPEERWLPIHTVETIMISVISMLADPNGDSPANVDAAKEWREDRNGEFKRKVARCVRKSQETAFE

SEQ ID NO: 10011 - protein, 956 aa, Human
ARGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 10012 - protein, 110 aa, Human
AMAYQLYRNTTLGNSLQESLDELIQSQQITPQLALQVLLQFDKAINAALAQRVRNRVNFRGSLNTYRFCDNVWTFVLNDVEFREVTELIKVDKVKIVACDGKNTGSNTTE

SEQ ID NO: 10013 - protein, 272 aa, Human
LFGSLTSTMAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRKNQIRKTSYAQHQQVRQIRKKMMEIMIREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 10014 - protein, 404 aa, Human
MLSLPPGLLTVSGSAAAADAVPLRPGDWAGVSTADRGERAPLGPAFCDLAVSPTSPAWRGEEDEGAKASSGDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 10015 - protein, 372 aa, Human
LGFGVRYWSQSARAANRGSEARSVPHSLLGSPEWTGISLGGTMEQYTANSNSSTEQIVVQAGQIQQQQQGGVTAVQLQTEAQVASASGQQVQTLQVVQGQPLMVQVSGGQLITSTGQPIMVQAVPGGQGQTIMQVPVSGTQGLQQIQLVPPGQIQIQGGQAVQVQGQQGQTQQIIIQQPQTAVTAGQTQTQQQIAVQGQQVAQTAEGQTIVYQPVNADGTILQQVTVPVSGMITIPAASLAGAQIVQTGANTNTTSSGQGTVTVTLPVAGNVVNSGGMVMMVPGAGSVPAIQRIPLPGAEMLEEEPLYVNAKQYHRILKRRQARAKLEAEGKIPKERRKYLHESRHRHAMARKRGEGGRFFSPKEKDSPHMQ

SEQ ID NO: 10016 - protein, 372 aa, Human; identical to SEQ ID NO: 10015

SEQ ID NO: 10017 - protein, 530 aa, Human
FRLGKMAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSRLDETIQAIANGTLNQPLTKLDRSSEEPLGVLVNPNMYQSPPQWVDHTGAASQKKAFRSSGFGLEFNSFQHQLRIQDQEFQEGFDGGWCLSVHQPWASLLVRGIKRVEGRSWYTPHRGRLWIAATAKKPSPQEVSELQATYRLLRGKDVEFPNDYPSGCLLGCVDLIDCLSQKQFKEQ

SEQ ID NO: 10018 - protein, 462 aa, Human
LHPFFPSTMAPKKMGSMKNKTKSHRISLQANATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 10019 - protein, 1171 aa, Human
MCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNAEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 10020 - protein, 390 aa, Human
DIRLRGQTGVRAERRGSYPFIDFRLLNSTTYSGEIGTKKKVKRLLSFQRYFHASRLLRGIIPQAPLHLLDEDYLGQARHMLSKVGMWDFDIFLFDRLTNVMVQEDYHSQNPYHNAVHAADVTQAMHCYLKEPKLASFLTPLDIMLGLLAAAAHDVDHPGVNQPFLIKTNHHLANLYQNMSVLENHHWRSTIGMLRESRLLAHLPKEMTQDIEQQLGSLILATDINRQNEFLTRLKAHLHNKDLRLEDAQDRHFMLQIALKCADICNPCRIWEMSKQWSERVCEEFYRQGELEQKFELEISPLCNQQKDSIPSIQIGFMSYIVEPLFREWAHFTGNSTLSENMLGHLAHNKAQWKSLLPRQHRSRGSSGSGPDHDHAGQGTESEEQEGDSP

SEQ ID NO: 10021 - protein, 510 aa, Human
PLLILKRGSWGASPYPGASPAPPRPAWPSPLPRGHRALLCLRAKVPEPAEQADDLQATVAALCVLRGGGPWAGSWLSPKTPGAMGGDLVLGLGALRRRKRLLEQEKSLAGWALVLAGTGIGLMVLHAEMLWFGGCSWALYLFLVKCTISISTFLLLCLIVAFHAKEVQLFMTDNGLRDWRVALTGRQAAQIVLELVVCGLHPAPVRGPPCVQDLGAPLTSPQPWPGFLGQGEALLSLAMLLRLYLVPRAVLLRSGVLLNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 10022 - protein, 580 aa, Human
APSKMAASETVRLRLQFDYPPPATPHCTAFWLLVDLNRCRVVTDLISLIRQRFGFSSGAFLGLYLEGGLLPPAESARLVRDNDCLRVKLEERGVAENSVVISNGDINLSLRKAKKRAFQLEEGEETEPDCKYSKKHWKSRENNNNNEKVLDLEPKAVTDQTVSKKNKRKNKATCGTVGDDNEEAKRKSPKKKEKCEYKKKAKNPKSPKVQAVKDWANQRCSSPKGSARNSLVKAKRKGSVSVCSKESPSSSSESESCDESISDGPSKVTLEARNSSEKLPTELSKEEPSTKNTTADKLAIKLGFSLTPSKGKTSGTTSSSSDSSAESDDQCLMSSSTPECAAGFLKTVGLFAGRGRPGPGLSSQTAGAAGWRRSGSNGGGQAPGASPSVSLPASLGRGWGREENLFSWKGAKGRGMRGRGRGRGHPVSCVVNRSTDNQRQQQLNDVVKNSSTIIQNPVETPKKDYSLLPLLAAAPQVGEKIAFKLLELTSSYSPDVSDYKEGRILSHNPETQQVDIEILSSLPALREPGKFDLVYHNENGAEVVEYAVTQESKITVFWKELIDPRLIIESPSNTSSTEPA

SEQ ID NO: 10023 - protein, 643 aa, Human
RGCSSCVPTPGSAMAELCPLAEELSCSICLEPFKEPVTTPCGHNFCGSCLNETWAVQGSPYLCPQCRAVYQARPQLHKNTVLCNVVEQFLQADLAREPPADVWTPPARASAPSPNAQVACDHCLKEAAVKTCLVCMASFCQEHLQPHFDSPAFQDHPLQPPVRDLLRRKCSQHNRLREFFCPEHSECICHICLVEHKTCSPASLSQASADLEATLRHKLTVMYSQINGASRALDDVRNRQQDVRMTANRKVEQLQQEYTEMKALLDASETTSTRKIKEEEKRVNSKFDTIYQILLKKKSEIQTLKEEIEQSLTKRDEFEFLEKASKLRGISTKPVYIPEVELNHKLIKGIHQSTIDLKNELKQCIGRLQELTPSSGDPGEHDPASTHKSTRPVKKVSKEEKKSKKPPPVPALPSKLPTFGAPEQLVDLKQAGLEAAAKATSSHPNSTSLKAKVLETFLAKSRPELLEYYIKVILDYNTAHNKVALSECYTVASVAEMPQNYRPHPQRFTYCSQVLGLHCYKKGIHYWEVELQKNNFCGVGICYGSMNRQGPESRLGRNSASWCVEWFNTKISAWHNNVEKTLPSTKATRVGVLLNCDHGFVIFFAVADKVHLMYKFRVDFTEALYPAFWVFSAGATLSICSPK

SEQ ID NO: 10024 - protein, 122 aa, Human
FRCLIAAIMGRMRAPEKGLSQSALPYRRSFPTWLKLTSDDVKEQIYKLAKKGLTPSQIGVIVRESHGVAQVRFVTGNKILRILKSKGLAPDLPEDLYHLIKKAVAVQSILRGTERIRMLNSI

SEQ ID NO: 10025 - protein, 309 aa, Human
EAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 10026 - protein, 591 aa, Human
GARALSPDPVPPAGLSCVEWCCAPCQQARLTMVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRNMFPANLVEATFKQYRTKTTPVVKSPKVAPEEAPPRRILIYGVQEENGSHVQNFALDLTPPPEVVYKSEPGTSDGMNVLGIVFFSATMGIMLGRMGDSGAPLVSFCQCLNESVMKIVAVAVWYFPFGIVFLIAGKILEMDDPRAVGKKLGFYSVTVVCGLVLHGLFILPLLYFFITKKNPIVFIRGILQALLIALATSSSSATLPITFKCLLENNHIDRRIARFVLPVGATINMDGTALYEAVAAIFIAQVNNYELDFGQIITISITATAASIGAAGIPQAGLVTMVIVLTSVGLPTDDITLIIAVDWALDRFRTMINVLGDALAAGIMAHICRKDFARDTGTEKLLPCETKPVSLQEIVAAQQNGCVKSVAEASELTLGPTCPHHVPVQVEQDEELPAASLNHCTIQISELETNV

SEQ ID NO: 10027 - protein, 836 aa, Human
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDHKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSA

SEQ ID NO: 10028 - protein, 836 aa, Human; identical to SEQ ID NO: 10027

SEQ ID NO: 10029 - protein, 518 aa, Human
GMEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 10030 - protein, 528 aa, Human
MQGPWVLLLLGLRLQLSLGVIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAHPVAASLPLLAGTLLLLGASAAP

SEQ ID NO: 10031 - protein, 245 aa, Human
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKMPGRLGPQRLLFQNLWKPRLNVP

SEQ ID NO: 10032 - protein, 520 aa, Human [sequence omitted]

SEQ ID NO: 10033 - protein, 370 aa, Human
RPGMRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAQVVGVGCVLDGVRYNNGQSFQPNCKYNCTCIDGAVGCTPLCLRVRPPRLWCPHPRRVSIPGHCCEQWVCEDDAKRPRKTAPRDTGAFDAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 10034 - protein, 289 aa, Human
LWASPAAPGKKKEMGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 10035 - protein, 849 aa, Human
HSALQCCGEARAATAAPVRPELGRGRPGGRTKRGGTAEAAPKCNSSTVRFQGLAEGTKGTMKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 10036 - protein, 565 aa, Human
LRAAGGGRTMPSFDEALQRVGEFGRFQRRVFLLLCLTGVTFAFLFVGVVFLGTQPDHYWCRGPSAAALAERCGWSPEEEWNRTAPASRGPEPPERRGRCQRYLLEAANDSASATSALSCADPLAAFPNRSAPLVPCRGGWRYAQAHSTIVSEFDLVCVNAWMLDLTQAILNLGFLTGAFTLGYAADRYGRIVIYLLSCLGVGVTGVVVAFAPNFPVFVIFRFLQGVFGKGTWMTCYVIVTEIVGSKQRRIVGIVIQMFFTLGIIILPGIAYFIPNWQGIQLAITLPSFLFLLYYWVVPESPRWLITRKKGDKALQILRRIAKCNGKYLSSNYSEITVTDEEVSNPSFLDLVRTPQMRKCTLILMFAWFTSAVVYQGLVMRLGIIGGNLYIDFFISGVVELPGALLILLTIERLGRRLPFAASNIVAGVACLVTAFLPEGIAWLRTTVATLGRLGITMAFEIVYLVNSELYPTTLRNFGVSLCSGLCDFGGIIAPFLLFRLAAVWLELPLIIFGILASICGGLVMLLPETKGIALPETVDDVEKLGSPHSCKCGRNKKTPVSRSHL

SEQ ID NO: 10037 - protein, 166 aa, Human
VSALPSLSGALQGLPVGTMRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 10038 - protein, 348 aa, Human
LIFCGCWLFASLTVMEAAHFFEGTEKLLEVWFSRQQPDANQGSGDLRTIPRSEWDILLKDVQCSIISVTKTDKQEAYVLSESSMFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 10039 - protein, 127 aa, Human
TLAFFLIPCIGSPACPTMSDAAVDTSSEITTKDLKEKKEVVEEAENGRDAPANGNANEENGEQEADNEVDEEEEEGGEEEEEEEEGDGEEEDGDEDEEAESATGKRAAEDDEDDDVDTKKQKTDEDD

SEQ ID NO: 10040 - protein, 747 aa, Human
LRVYVLRDLQHPRPPSPSLGFFWTHLRHLSASHSAAIMVKLAKAGKNQGDPKKMAPPPKEVEEDSEDEEMSEDEEDDSSGEEVVIPQKKGKKAAATSAKKVVVSPTKKVAVATPAKKAAVTPGKKAAATPAKKTVTPAKAVTTPGKKGATPGKALVATPGKKGAAIPAKGAKNGKNAKKEDSDEEEDDDSEEDEEDDEDEDEDEDEIEPAAMKAAAAAPASEDEDDEDDEDDEDDDDDEEDDSEEEAMETTPAKGKKAAKVVPVKAKNVAEDEDEEEDDEDEDDDDDEDDEDDDDEDDEEEEEEEEEEPVKEAPGKRKKEMAKQKAAPEAKKQKVEGTEPTTAFNLFVGNLNFNKSAPELKTGISDVFAKNDLAVVDVRIGMTRKFGYVDFESAEDLEKALELTGLKVFGNEIKLEKPKGKDSKKERDARTLLAKNLPYKVTQDELKEVFEDAAEIRLVSKDGKSKGIAYIEFKTEADAEKTFEEKQGTEIDGRSISLYYTGEKGQNQDYRGGKNSTWSGESKTLVLSNLSYSATEETLQEVFEKATFIKVPQNQNGKSKGYAFIEFASFEDAKEALNSCNKREIEGRAIRLELQGPRGSPNARSQPSKTLFVKGLSEDTTEETLKESFDGSVRARIVTDRETGSSKGFGFVDFNSEEDAKAAKEAMEDGEIDGNKVTLDWAKPKGEGGFGGRGGGRGGFGGRGGGRGGRGGFGGRGRGGFGGRGGFRGGRGGGGDHKPQGKKTKFE

SEQ ID NO: 10041 - protein, 126 aa, Human
MHLSQLLACALLLTLLSLRPSEAKPGAPPKVPRTPPAEELAEPQAAGGGQKKGDKAPGGGGANLKGDRSRLLRDLRVDTKSRAAWARLLQEHPNARKYKGANKKGLSKGCFGLKLDRIGSMSGLGC

SEQ ID NO: 10042 - protein, 440 aa, Human
APREQRSARLTPTCPAQEPCRLEGGWRAAAPGGEAGAAGRDSGSAHQPLRPGTASMSKPAGSTSRILDIPCKVCGDRSSGKHYGVYACDGCSGFFKRSIRRNRTYVCKSGNQGGCPVDKTHRNQCRACRLKKCLEVNMNKDAVQHERGPRTSTIRKQVALYFRGHKEENGAAAHFPSAALPAPAFFTAVTQLEPHGLELAAVSTTPERQTLVSLAQPTPKYPHEVNGTPMYLYEVATESVCESAARLLFMSIKWAKSVPAFSTLSLQDQLMLLEDAWRELFVLGIAQWAIPVDANTLLAVSGMNGDNTDSQKLNKIISEIQALQEVVARFRQLRLDATEFACLKCIVTFKAVPTHSGSELRSFRNAAAIAALQDEAQLTLNSYIHTRYPTQPCRFGKLLLLLPALRSISPSTIEEVFFKKTIGNVPITRLLSDMYKSSDI

SEQ ID NO: 10043 - protein, 409 aa, Human
RQRRADGGRRSKMNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRKGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 10044 - protein, 409 aa, Human; identical to SEQ ID NO: 10043

SEQ ID NO: 10045 - protein, 223 aa, Human
SMLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 10046 - protein, 563 aa, Human
TCIAAVKMEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 10047 - protein, 563 aa, Human; identical to SEQ ID NO: 10046

SEQ ID NO: 10048 - protein, 360 aa, Human
FSPRRSPALRALPGGPRPAAPGPWPRGAMLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 10049 - protein, 206 aa, Human
LSVASLSFLPNASAEDTMSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLEIRCHTRNYIPDLKK

SEQ ID NO: 10050 - protein, 726 aa, Human
PTLLLSSLVLPQAAAAAPGSRSLRGVHVPPPLHPAPAREESARAPAAGGRAAKMAEAPASPAPLSPLEVELDPEFEPQSRPRSCTWPLQRPELQASPAKPSGETAADSMIPEEEDDEDDEDGGGRAGSAMAIGGGGGSGTLGSGLLLEDSARVLAPGGQDPGSGPATAAGGLSGGTQALLQPQQPLPPPQPGAAGGSGQPRKCSSRRNAWGNLSYADLITRAIESSPDKRLTLSQIYEWMVRCVPYFKDKGDSNSSAGWKNSIRHNLSLHSRFMRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 10051 - protein, 483 aa, Human
GGKMAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 10052 - protein, 158 aa, Human
DGQDLGPWADASKQAEAGMASRKTKKKEGGALRAQRASSNVFSNFEQTQIQEFKEAFTLMDQNRDGFIDKEDLKDTYASLGKTNVKDDELDAMLKEASGPINFTMFLNLFGEKLSGTDAEETILNAFKMLDPDGKGKINKEYIKRLLMSQADKMTAEE

SEQ ID NO: 10053 - protein, 163 aa, Human
SPRKNTRSRPYLRVSSDPWRSHCGSRAIAMEFVMKQALGGATKDMGKMLGGDEEKDPDAAKKEEERQEALRQAEEERKAKYAKMEAEREAVRQGIRDKYGIKKKEEREAEAQAAMEANSEGSLTRPKKAIPPGCGDEVEEEDESILDTVIKYLPGPLQDMLKK

SEQ ID NO: 10054 - protein, 511 aa, Human
PRSGQAEMTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPQGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 10055 - protein, 487 aa, Human
LVAKTPEYFRSGEMELLTFRDVAIEFSPEEWKCLDPDQQNLYRDVMLENYRNLVSLGVAISNPDLVTCLEQRKEPYNVKIHKIVARPPAMCSHFTQDHWPVQGIEDSFHKLILRRYEKCGHDNLQLRKGCKSLNECKLQKGGYNEFNECLSTTQSKILQCKASVKVVSKFSNSNKRKTRHTGEKHFKECGKSFQKFSHLTQHKVIHAGEKPYTCEECGKAFKWSLIFNEHKRIHTGEKPFTCEECGSIFTTSSHFAKHKIIHTGEKPYKCEECGKAFNRFTTLTKHKRIHAGEKPITCEECRKIFTSSSNFAKHKRIHTGEKPYKCEECGKAFNRSTTLTKHKRIHTGEKPYTCEECGKAFRQSSKLNEHKKVHTGERPYKCDECGKAFGRSRVLNEHKKIHTGEKPYKCEECGKAFRRSTDRSQHKKIHSADKPYKCKECDKAFKQFSLLSQHKKIHTVDKPYKCKDCDKAFKRFSHLNKHKKIHT

SEQ ID NO: 10056 - protein, 423 aa, Human
VLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKASGSRVRHRNLQWRPSTQVFNLLYPVSTGPMGTLWLPQSSPTRIWVLPVAICYKRLGSPRK

SEQ ID NO: 10057 - protein, 381 aa, Human
MAESHLLQWLLLLLPTLCGPGTAAWTTSSLACAQGPEFWCQSLEQALQCRALGHCLQEVWGHVGADDLCQECEDIVHILNKMAKEAIFQDTMRKFLEQECNVLPLKLLMPQCNQVLDDYFPLVIDYFQNQTDSNGICMHLGLCKSRQPEPEQEPGMSDPLPKPLRDPLPDPLLDKLVLPVLPGALQARPGPHTQDLSEQQFPIPLPYCWLCRALIKRIQAMIPKGALAVAVAQVCRVVPLVAGGICQCLAERYSVILLDTLLGRMLPQLVCRLVLRCSMDDSAGPRSPTGEWLPRDSECHLCMSVTTQAGNSSEQAIPQAMLQACVGSWLDREKCKQFVEQHTPQLLTLVPRGWDAHTTCQALGVCGTMSSPLQCIHSPDL

SEQ ID NO: 10058 - protein, 766 aa, Human
PTCLLRRAMAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 10059 - protein, 416 aa, Human
SQPLPPRRCSFVRPLPHTDTNMNGQLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 10060 - protein, 383 aa, Human
FPLILVPSVGHRVQNLRATQGWKEDEPTKQRSEDSMYTAIPQSGSPFPGSVQDPGLHVWRVEKLKPVPVAQENQGVFFSGDSYLVLHNGPEEVSHLHLWIGQQSSRDEQGACAVLAVHLNTLLGERPVQHREVQGNESDLFMSYFPRGLKYQEGGVESAFHKTSTGAPAAIKKLYQVKGKKNIRATERALNWDSFNTGDCFILDLGQNIFAWCGGKSNILERNKARDLALAIRDSERQGKAQVEIVTDGEEPAEMIQVLGPKPALKEGNPEEDLTADKANAQAAALYKVSDATGQMNLTKVADSSPFALELLISDDCFVLDNGLCGKIYIWKGRKANEKERQAALQVAEGFISRMQYAPNTQVEILPQGRESPIFKQFFKDWK

SEQ ID NO: 10061 - protein, 307 aa, Human
KIKLKIASSPRKHQMADDAGAAGGPRGPGGHGIGNRGGFHGGFGSGIRGRGRGSGRGRGRGRGARGGKAEDKEWMPVTKLGRLVKDMKIKSLEEIYLFSLPIKESEIIDFFLGDSLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQASDVATT

SEQ ID NO: 10062 - protein, 325 aa, Human
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKVFLLLLKVNHSLFEGRC

SEQ ID NO: 10063 - protein, 1239 aa, Human
GKMDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 10064 - protein, 1239 aa, Human; identical to SEQ ID NO: 10063

SEQ ID NO: 10065 - protein, 1196 aa, Human
GKMDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 10066 - protein, 1196 aa, Human; identical to SEQ ID NO: 10065

SEQ ID NO: 10067 - protein, 377 aa, Human
ATFPREWLCDRHLREKMFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 10068 - protein, 377 aa, Human; identical to SEQ ID NO: 10067

SEQ ID NO: 10069 - protein, 389 aa, Human
LAVHATVKNLSVYSESCKLLVSPLGGRLGARPLLLFHLWIRQFLVRFRRRSRALGAVRPLGQRRCLPTRSSELRRRPAGKMSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEVKPVIHSRINVSARFRKPLQEPCTIFLIANGDLINPASRLLIPRKTLNQWDHVLQMVTEKITLRSGAVHRLYTLEGKLVESGAELENGQFYVAVGRDKFKKLPYGELLFDKSTMRRPFGQKASSLPPIVGSRKSKGSGNDRHSKSTVGSSDNSSPQPLKRKGKKEDVNSEKLTKLKQNVKLKNSQETIPNSGK

SEQ ID NO: 10070 - protein, 386 aa, Human
GPRRPKSAVHSMSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 10071 - protein, 236 aa, Human
SVFPATITNMNIKGSPWKGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 10072 - protein, 313 aa, Human
KEQEREMRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRYPLCYISRYSKN

SEQ ID NO: 10073 - protein, 444 aa, Human
SGQPPPPPPQQQQQQQQLSPPPPAALAPVSGVVLPAPPAVSAGSSPAGSPGGGAGGEGLGAAAAALLLHPPPPPPPATAAPPPPPPPPPPPASAAAPASGPPAPPGLAAGPGPAGGAPTPALVAGSSAAAPFPHGDSALNEQEKELQRRLKRLYPAVDEQETPLPRSWSPKDKFSYIGLSQNNLRVHYKGHGKTPKDAASVRATHPIPAACGIYYFEVKIVSKGRDGYMGIGLSAQGVNMNRLPGWDKHSYGYHGDDGHSFCSSGTGQPYGPTFTTGDVIGCCVNLINNTCFYTKNGHSLGIAFTDLPPNLYPTVGLQTPGEVVDANFGQHPFVFDIEDYMREWRTKIQAQIDRFPIGDREGEWQTMIQKMVSSYLVHHGYCATAEAFARSTDQTVLEELASIKNRQRIQKLVLAGRMGEAIETTQQLYPSLLERNPNLLFTLK

SEQ ID NO: 10074 - protein, 489 aa, Human
HSRGPEPEAQQSREATEERPGEGQALLNPSAPPPWTRPHPEYPGHAPRPWPPLHPLQLCSSRAAATSPGTPPPHPASISRPRPPGPLPLRGHRPRPQPTGPGPPRTLRTLWSSPGRKMPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 10075 - protein, 656 aa, Human
LSHLIIDKIIHTEDKPYKCEECGKAFKQLSTLTTHKIICAKEKIYKCEECGKAFLWSSTLTRHKRIHTGEKPYKCEECGKAFSHSSTLAKHKRIHTGEKPYKCEECGKAFSRSSTLAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRIHTREKPFKCKECGKAFIWSSTLTRHKRIHTGEKPYKCEECGKAFSRSSTLTKHKTIHTGEKPYKCKECGKAFKHSSALAKHKIIHAGEKLYKCEECGKAFNQSSNLTTHKIIHTKEKPSKSEECDKAFIWSSTLTEHKRIHTREKTYKCEECGKAFSQPSHLTTHKRMHTGEKPYKCEECGKAFSQSSTLTTHKIIHTGEKPYKCEECGKAFRKSSTLTEHKIIHTGEKPYKCEECGKAFSQSSTLTRHTRMHTGEKPYKCEECGKAFNRSSKLTTHKIIHTGEKPYKCEECGKAFISSSTLNGHKRIHTREKPYKCEECGKAFSQSSTLTRHKRLHTGEKPYKCGECGKAFKESSALTKHKIIHTGEKPYKCEKCGKAFNQSSILTNHKKIHTITPVIPHFGRPRRADHEVRRWRPSWLTQ

SEQ ID NO: 10076 - protein, 1989 aa, Human
LTKLLQDEKMAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSLFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 10077 - protein, 300 aa, Human
AVYISQIRRGVRRRVKQVFGLRRPRPRQKPVRRQWAARLIFSLARTLPKPAPSSGSRAHRWPPAVSGAHGAALIGLAAQASSRSNMNLVGSYAHHHHHHHPHPAHPMLHEPFLFGPASRCHQERPYFQSWLLSPADAAPDFPAGGPPPAAAAAATAYGPDARPGQSPGRLEALGGRLGRRKGSGPKKERRRTESINSAFAELRECIPNVPADTKLSKIKTLRLATSYIAYLMDVLAKDAQSGDPEAFKAELKKADGGRESKRKRELQQHEGFPPALGPVEKRIKGRTGWPQQVWALELNQ

SEQ ID NO: 10078 - protein, 527 aa, Human
QKVPGWGMPQLSLSSLGLWPMAASPWLLLLLVGASWLLARILAWTYTFYDNCCRLRCFPQPPKRNWFLGHLGLIHSSEEGLLYTQSLACTFGDMCCWWVGPWHAIVRIFHPTYIKPVLFAPAAIVPKDKVFYSFLKPWLGDGLLLSAGEKWSRHRRMLTPAFHFNILKPYMKIFNESVNIMHAKWQLLASEGSARLDMFEHISLMTLDSLQKCVFSFDSHCQEKPSEYIAAILELSALVTKRHQQILLYIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAQLPFLTMCIKESLRLHPPVPAVSRCCTQDIVLPDGRVIPKGIICLISVFGTHHNPAVWPDPEVYDPFRFDPKNIKERSPLAFIPFSAGPRNCIGQAFAMAEMKVVLGLTLLRFRVLPDHTEPRRKPELVLRAEGGLWLRVEPLS

SEQ ID NO: 10079 - protein, 161 aa, Human
SELVVDKTKRKKRRELSEEQKQEIKDAFELFDTDKDEAIDYHELKVAMRALGFDVKKADVLKILKDYDREATGKITFEDFNEVVTDWILERDPHEEILKAFKLFDDDDSGKISLRNLRRVARELGENMSDEELRAMIEEFDKDGDGEINQEEFIAIMTGDI

SEQ ID NO: 10080 - protein, 749 aa, Human
PTSHPPLGSSPLGRRFRVLSSLRRSPMFEEKASSPSGKMGGEEKPIGAGEEKQKEGGKKKNKEGSGDGGRAELNPWPEYIYTRLEMYNILKAEHDSILAEKAEKDSKPIKVTLPDGKQVDAESWKTTPYQIACGISQGLADNTVIAKVNNVVWDLDRPLEEDCTLELLKFEDEEAQAVYWHSSAHIMGEAMERVYGGCLCYGPPIENGFYYDMYLEEGGVSSNDFSSLEALCKKIIKEKQAFERLEVKKETLLAMFKYNKFKCRILNEKVNTPTTTVYRCGPLIDLCRGPHVRHTGKIKALKIHKNSSTYWEGKADMETLQRIYGISFPDPKMLKEWEKFQEEAKNRDHRKIGRDQELYFFHELSPGSCFFLPKGAYIYNALIEFIRSEYRKRGFQEVVTPNIFNSRLWMTSGHWQHYSENMFSFEVEKELFALKPMNCPGHCLMFDHRPRSWRELPLRLADFGVLHRNELSGALTGLTRVRRFQQDDAHIFCAMEQIEDEIKGCLDFLRTVYSVFGFSFKLNLSTRPEKFLGDIEVWDQAEKQLENSLNEFGEKWELNSGDGAFYGPKIDIQIKDAIGRYHQCATIQLDFQLPIRFNLTYVSHDGDDKKRPVIVHRAILGSVERMIAILTENYGGKWPFWLSPRQVMVVPVGPTCDEYAQKVRQQFHDAKFMADIDLDPGCTLNKKIRNAQLAQYNFILVVGEKEKISGTVNIRTRDNKVHGERTISETIERLQQLKEFRSKQAEEEF

SEQ ID NO: 10081 - protein, 1119 aa, Human
SQLRKGASATHSSPSRTDCIAQMMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 10082 - protein, 489 aa, Human
QERERKGRKKYIISGTRERRKTGTMGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 10083 - protein, 595 aa, Human
GREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVRWFCFSSTHLSCHPESTDVQYHLRFSISYCCKNTDISG

SEQ ID NO: 10084 - protein, 595 aa, Human; identical to SEQ ID NO: 10083

SEQ ID NO: 10085 - protein, 543 aa, Human
NMTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 10086 - protein, 724 aa, Human
KVGGSRVVQVRARLARRGFTVTCLEVMRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 10087 - protein, 231 aa, Human
ARVAVASVQGKMASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 10088 - protein, 700 aa, Human
PREPRPLSPLPTPDGAGTGCRASSHPPSPSCLLGPCQLPPLEHAGRPRTRWASAPALMEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 10089 - protein, 1125 aa, Human
QVALMAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVHELMKLCWAPSPQDRPSFSALGPQLDMLWSGSRGCETHAFTAHPEGKHHSLSFS

SEQ ID NO: 10090 - protein, 350 aa, Human
GGSKTWPKAEKELTDRNWDQEDEAEEVGTFSVASEEVLKNRAIKKAKRRNVGFESDSRGGFKSFKGLVVPSGGGRFPGFGSGAGGKPLEGLSNGNNITSAPPFTSAKAVAEPKVAFGSLAANGPTALVDKKVSNPKTNGDSQQPSSSGLASSKACVRNAYHKQLAALNCSVRDWIVKHVNTNPLCDLTPIFKDYEKYLANIEQQHGNSGRNSESESNKAAAETRSPSLVGSTKLQQESAFLFHGNKTEDTPDKKVELTSEKKTDPSSLGATSASFNFGKKVDSSVLGSLSSVPLTGFSFSPGNSSLFGKDITRVNQSLHHFALNHWRAKRKVTVVNAKVEMKKRIMSYPK

SEQ ID NO: 10091 - protein, 587 aa, Human
RGQPLCSGSARRPLHPRVSAGAQPLSHAGPRAACSEPNPCTQVVMNSHSYNGSVGRPLGSGPGALGRDPPDPEAGHPPQPPHSPGLQVVVAKSEPARPSPGSPRGQPQDQDDDEDDEEDEAGRQRASGKPSNVGHRLGHRRALFEKRKRLSDYALIFGMFGIVVMVTETELSWGVYTKESLYSFALKCLISLSTAILLGLVVLYHAREIQLFMVDNGADDWRIAMTCERVFLISLELAVCAIHPVPGHYRFTWTARLAFTYAPSVAEADVDVLLSIPMFLRLYLLGRVMLLHSKIFTDASSRSIGALNKITFNTRFVMKTLMTICPGTVLLVFSISSWIIAAWTVRVCERYHDKQEVTSNFLGAMWLISITFLSIGYGDMVPHTYCGKGVCLLTGIMGAGCTALVVAVVARKLELTKAEKHVHNFMMDTQLTKRVKNAAANVLRETWLIYKHTRLVKKPDQARVRKHQRKFLQAIHHPHRLRSVKIEQGKLNDQANTLTDLAKTQTVMYDLVSELHAQHEELEARLATLESRLDALGASLQALPGLIAQAIRPPPPPLPPRPGPGPQDQAARSSPCRWTPVAPSDCG

SEQ ID NO: 10092 - protein, 683 aa, Human
VAEPRRWQRGSPGAVGLYVDPMEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 10093 - protein, 259 aa, Human
APRMQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 10094 - protein, 390 aa, Human
EFPGRPRSSGGSGSLCRPRKPGVGGTQTRAVRPAVCSADSARPHLPLRRADMKDSLVLLGRVPAHPDSRCWFLAWNPAGTLLASCGGDRRIRIWGTEGDSWICKSVLSEGHQRTVRKVAWSPCGNYLASASFDATTCIWKKNQDDFECVTTLEGHENEVKSVAWAPSGNLLATCSRDKSVWVWEVDEEDEYECVSVLNSHTQDVKHVVWHPSQELLASASYDDTVKLYREEEDDWVCCATLEGHESTVWSLAFDPSGQRLASCSDDRTVRIWRQYLPGNEQGVACSGSDPSWKCICTLSGFHSRTIYDIAWCQLTGALATACGDDAIRVFQEDPNSDPQQPTFSLTAHLHQAHSQDVNCVAWNPKEPGLLASCSDDGEVAFWKYQRPEGL

SEQ ID NO: 10095 - protein, 386 aa, Human
QLFMVDNGADDWRIAMTYERIFFICLEILVCAIHPIPGNYTFTWTARLAFSYAPSTTTADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 10096 - protein, 171 aa, Human
RKLRAGFLPGFCRVSPCGSWVVETLVKMACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSRKSVMLYAAEMIPKLKTRTQKTGGADQSLQQGEGSKKGKGKKKK

SEQ ID NO: 10097 - protein, 171 aa, Human [sequence omitted]

SEQ ID NO: 10098 - protein, 355 aa, Human
KHFLAFSSLLWPSHLDMRQYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 10099 - protein, 1282 aa, Human
GGHACPRRENFSCRLSWGGGGRKCGQRPLLRLPRAPCRRSALSLRSSLWGPPFPVAGESRLERGARPRGGRQARAKAKGVWWRRRLGAEQGGDSHPHPRARRSRSPGEGSLRRLLPRVHSALSPLAEESVLAPSLSRKMKLSRQFTVFGSAIFCVVIFSLYLMLDRGHLDYPRNPRREGSFPQGQLSMLQEKIDHLERLLAENNEIISNIRDSVINLSESVEDGPKSSQSNFSQGAGSHLLPSQLSLSVDTADCLFASQSGSHNSDVQMLDVYSLISFDNPDGGVWKQGFDITYESNEWDTEPLQVFVVPHSHNDPGWLKTFNDYFRDKTQYIFNNMVLKLKEDSRRKFIWSEISYLSKWWDIIDIQKKDAVKSLIENGQLEIVTGGWVMPDEATPHYFALIDQLIEGHQWLENNIGVKPRSGWAIDPFGHSPTMAYLLNRAGLSHMLIQRVHYAVKKHFALHKTLEFFWRQNWDLGSVTDILCHMMPFYSYDIPHTCGPDPKICCQFDFKRLPGGRFGCPWGVPPETIHPGNVQSRARMLLDQYRKKSKLFRTKVLLAPLGDDFRYCEYTEWDLQFKNYQQLFDYMNSQSKFKVKIQFGTLSDFFDALDKADETQRDKGQSMFPVLSGDFFTYADRDDHYWSGYFTSRPFYKRMDRIMESHLRAAEILYYFALRQAHKYKINKFLSSSLYTALTEARRNLGLFQHHDAITGTAKDWVVVDYGTRLFHSLMVLEKIIGNSAFLLILKDKLTYDSYSPDTFLEMDLKQKSQDSLPQKNIIRLSAEPRYLVVYNPLEQDRISLVSVYVSSPTVQVFSASGKPVEVQVSAVWDTANTISETAYEISFRAHIPPLGLKVYKILESASSNSHLADYVLYKNKVEDSGIFTIKNMINTEEGITLENSFVLLRFDQTGLMKQMMTKEDGKHHEVNVQFSWYGTTIKRDKSGAYLFLPDGNAKPYVYTTPPFVRVTHGRIYSEVTCFFDHVTHRVRLYHIQGIEGQSVEVSNIVDIRKVYNREIAMKISSDIKSQNRFYTDLNGYQIQPRMTLSKLPLQANVYPMTTMAYIQDAKHRLTLLSAQSLGVSSLNSGQIEVIMDRRLMQDDNRGLEQGIQDNKITANLFRILLEKRSAVNTEEEKKSVSYPSLLSHITSSLMNHPVIPMANKFSSPTLELQGEFSPLQSSLPCDIHLVNLRTIQSKVGNGHSNEAALILHRKGFDCRFSSKGTGLFCSTTQGKILVQKLLNKFIVESLTPSSLSLMHSPPGTQNISEINLSPMEISTFRIQLR

SEQ ID NO: 10100 - protein, 130 aa, Human
VSRAIPRRERGTNTKDTQPPFGNPTVPPGDAFDIIAQSPPITCHRKHQGLGTPEIHLTAHPKKGLVIGFWQMSDFCFLSFSLNSKQQLQVGGLNLFLPPSPHPAPPPALALGFSHPSQIKWTPDENAKLS

SEQ ID NO: 10101 - protein, 412 aa, Human
MEKLQNASWIYQQKLEDPFQKHLNSTEEYLAFLCGPRRSHFFLPVSVVYVPIFVVGVIGNVLVCLVILQHQAMKTPTNYYLFSLAVSDLLVLLLGMPLEVYEMWRNYPFLFGPVGCYFKTALFETVCFASILSITTVSVERYVAILHPFRAKLQSTRRRALRILGIVWGFSVLFSLPNTSIHGIKFHYFPNGSLVPGSATCTVIKPMWIYNFIIQVTSFLFYLLPMTVISVLYYLMALRLKKDKSLEADEGNANIQRPCRKSVNKMLFVLVLVFAICWAPFHIDRLFFSFVEEWSESLAAVFNLVHVVSGVFFYLSSAVNPIIYNLLSRRFQAAFQNVISSFHKQWHSQHDPQLPPAQRNIFLTECHFVELTEDIGPQFPCQSSMHNSHLPTALSSEQMSRTNYQSFHFNKT

SEQ ID NO: 10102 - protein, 441 aa, Human
CRTENASIFSLPSPPQVLICRNYRGDVDMSEVEHFMPILMEKEEEGMLSPILAHGGVRFMWIKHNNLYRIPLLGVLPGDSCVGVVVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 10103 - protein, 522 aa, Human
AHRAGGAAAASQNPSGGGDSSIAGFLFFFSPPPRLLLRLGPWCSPTGSPAPLSCETGCGEGSWILVCRLLVPTQVSLLSMEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 10104 - protein, 235 aa, Human
RSSGLLGSLAPSSLARSAPPPQPSSETRAQPAPHEMEQTEVLKPRTLADLIRILHQLFAGDEVNVEEVQAIMEAYESDPTEWAMYAKFDQYRYTRNLVDQGNGKFNLMILCWGEGHGSSIHDHTNSHCFLKMLQGNLKETLFAWPDKKSNEMVKKSERVLRENQCAYINDSIGLHRVENISHTEPAVSLHLYSPPFDTCHAFDQRTGHKNKVTMTFHSKFGIRTPNATSGSLENN

SEQ ID NO: 10105 - protein, 221 aa, Human
IAGEITRRGSRARPRPGPQCPPGRPGTAMIKAILIFNNHGKPRLSKFYQPYSEDTQQQIIRETFHLVSKRDENVCNFLEGGLLIGGSDNKLIYRHYATLYFVFCVDSSESELGILDLIQVFVETLDKCFENVCELDLIFHVDKVHNILAEMVMGGMVLETNMNEIVTQIDAQNKLEKSEAGLAGAPARAVSAVKNMNLPEIPRNINIGDISIKVPNLPSFK

SEQ ID NO: 10106 - protein, 378 aa, Human
KFLSSPNLNKILSHFPMKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDMSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 10107 - protein, 377 aa, Human
SSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPGKGNYWTLDPNCEKMFDNGNFRRKRKRKSDVSSSTASLALEKTESSLPVDSPKTTEPQDILDGASPGGTTSSPEKRPSPPPSGAPCLNSFLSSMTAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 10108 - protein, 274 aa, Human
DRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 10109 - protein, 2317 aa, Human
SGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSE

SEQ ID NO: 10110 - protein, 293 aa, Human
LQDKMKLIILEHYSQASEWAAKYIRNRIIQFNPGPEKYFTLGLPTGSTPLGCYKKLIEYYKNGDLSFKYVKTFNMDEYVGLPRDHPESYHSFMWNNFFKHIDIHPENTHILDGNAVDLQAECDAFEEKIKAAGGIELFVGGIGPDGHIAFNEPGSSLVSRTRVKTLAMDTILANARFFDGELTKVPTMALTVGVGTVMDAREVMILITGAHKAFALYKAIEEGVNHMWTVSAFQQHPRTVFVCDEDATLELKVKTVKYFKGLMLVHNKLVDPLYSIKEKETEKSQSSKKPYSD

SEQ ID NO: 10111 - protein, 487 aa, Human
GLWSPLSEHSEVLMSSEDREAQEDELLALASIYDGDEFRKAESVQGGETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELDFGGAAGSDVDQEEIVDERAVQDVESLSNLIQEILDFDQAQQIKCFNSKLFLCSICFCEKLGSECMYFLECRHVYCKACLKDYFEIQIRDGQVQCLNCPEPKCPSVATPGQVKELVEAELFARYDRLLLQSSLDLMADVVYCPRPCCQLPVMQEPGCTMGICSSCNFAFCTLCRLTYHGVSPCKVTAEKLMDLRNEYLQADEANKRLLDQRYGKRVIQKALEEMESKEWLEKNSKSCPCCGTPIEKLDGCNKMTCTGCMQYFCWICMGSLSRANPYKHFNDPGSPCFNRLFYAVDVDDDIWEDEVED

SEQ ID NO: 10112 - protein, 303 aa, Human
LAEDDFSGFFRMPAALVENSQVICEVWASNLEEEMRKIREIVLSYSYIAMDTEFPGVVVRPIGEFRSSIDYQYQLLRCNVDLLKIIQLGLTFTNEKGEYPSGINTWQFNFKFNLTEDMYSQDSIDLLANSGLQFQKHEEEGIDTLHFAELLMTSGVVLCDNVKWLSFHSGYDFGYMVKLLTDSRLPEEEHEFFHILNLFFPSIYDVKYLMKSCKNLKGGLQEVADQLDLQRIGRQHQAGSDSLLTGMAFFRMKELFFEDSIDDAKYCGRLYGLGTGVAQKQNEDVDSAQEKMSILAIINNMQQ

SEQ ID NO: 10113 - protein, 340 aa, Human
CVWVLVCRPSGPGHDSIMYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 10114 - protein, 69 aa, Human
RASSSGMLGQSIRRFTTSVVRRSHYEEGPGKNLPFSVENKWSLLAKMCLYFGSAFATPFLVVRHQLLKT

SEQ ID NO: 10115 - protein, 627 aa, Human
AELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGLFMEILSSCSDCDEIQFMEDGSWCPMKPKKEASEVCPPPGYGLDGLQYSPVQGGDPSENKKKVEVIDLTIESSSDEEDLPPTKKHCSVTSAAIPALPGSKGVLTSGHQPSSVLRSPAMGTLGGDFLSSLPLHEYPPAFPLGADIQGLDLFSFLQTESQHYGPSVITSLDEQDALGHFFQYRGTPSHFLGPLAPTLGSSHCSATPAPPPGRVSSIVAPGGALREGHGGPLPSGPSLTGCRSDIISLD

SEQ ID NO: 10116 - protein, 1140 aa, Human
ASARRRARVQRGTGPRALPGGTMSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 10117 - protein, 765 aa, Human
ATQLPATAMVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 10118 - protein, 314 aa, Human
AATCTAMPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 10119 - protein, 680 aa, Human
YQSQSFDEDEMNQVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 10120 - protein, 735 aa, Human
RHFVRSKVASTFPERLLRFCLDRPLTTDMSRDRFRSRGGGGGGFHRRGGGGGRGGLHDFRSPPPGMGLNQNRGPMGPGPRQSGPKPPIPPPPPHQQQQQPPPQQPPPQQPPPHQPPPHPQPHQQQQPPPPPQDSSKPVVAQGPGPAPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGRSEEKISDSEGFKANLSLLRRPGEKTYTQRCRLFVGNLPADITEDEFKRLFAKYGEPGEVFINKGKGFGFIKLESRALAEIAKAELDDTPMRGRQLRVRFATHAAALSVRNLSPYVSNELLEEAFSQFGPIERAVVIVDDRGRSTGKGIVEFASKPAARKAFERCSEGVFLLTTTPRPVIVEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMRTERFGQGGAGPVGGQGPRGMGPGTPAGYGRGREEYEGPNKKPRF

SEQ ID NO: 10121 - protein, 416 aa, Human
GLGLLCPAFNNLSYALFWVTLESDLLSSIFCFLASVSCYFGLATMGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKNGDTLYTCALRPTYIYGEGGPFLSASINEALNNNGILSSVGKFSTVNPVYVGNVAWAHILALRALRDPKKAPSVRGQFYYISDDTPHQSYDNLNYILSKEFGLRLDSRWSLPLTLMYWIGFLLEVVSFLLSPIYSYQPPFNRHTVTLSNSVFTFSYKKAQRDLAYKPLYSWEEAKQKTVEWVGSLVDRHKETLKSKTQ

SEQ ID NO: 10122 - protein, 955 aa, Human
TDCFTCGIRHHNMGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVKWWDLDTQHCFKTMVGHRTEVWGLVLLSEEKRLITGASDSELRVWDIAYLQEIEDPEEPDPKKIKGSSPGIQDTLEAEDGAFETDEAPEDRILSCRKAGSIMREGRDRVVNLAVDKTGRILACHGTDSVLELFCILSKKEIQKKMDKKMKKARKKAKLHSSKGEEEDPEVNVEMSLQDEIQRVTNIKTSAKIKSFDLIHSPHGELKAVFLLQNNLVELYSLNPSLPTPQPVRTSRITIGGHRSDVRTLSFSSDNIAVLSAAADSIKIWNRSTLQCIRTMTCEYALCSFFVPGDRQVVIGTKTGKLQLYDLASGNLLETIDAHDGALWSMSLSPDQRGFVTGGADKSVKFWDFELVKDENSTQKRLSVKQTRTLQLDEDVLCVSYSPNQKLLAVSLLDCTVKIFYVDTLKFFLSLYGHKLPVICMDISHDGALIATGSADRNVKIWGLDFGDCHKSLFAHDDSVMYLQFVPKSHLFFTAGKDHKIKQWDADKFEHIQTLEGHHQEIWCLAVSPSGDYVVSSSHDKSLRLWERTREPLILEEEREMEREAEYEESVAKEDQPAVPGETQGDSYFTGKKTIETVKAAERIMEAIELYREETAKMKEHKAICKAAGKEVPLPSNPILMAYGSISPSAYVLEIFKGIKSSELEESLLVLPFSYVPDILKLFNEFIQLGSDVELICRCLFFLLRIHFGQITSNQMLVPVIEKLRETTISKVSQVRDVIGFNMAGLDYLKRECEAKSEVMFFADATSHLEEKKRKRKKREKLILTLT

SEQ ID NO: 10123 - protein, 642 aa, Human
TMTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSGNPAVR

SEQ ID NO: 10124 - protein, 253 aa, Human
RRAMVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 10125 - protein, 1155 aa, Human
LRLGLGAAAAATRAAGGAGRSGGFKEENMAENKGGGEAESGGGGSGSAPVTAGAAGPAAQEAEPPLTAVLVEEEEEEGGRAGAEGGAAGPDDGGVAAASSGSAQAASSPAASVGTGVAGGAVSTPAPAPASAPAPGPSAGPPPGPPASLLDTCAVCQQSLQSRREAEPKLLPCLHSFCLRCLPEPERQLSVPIPGGSNGDIQQVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKTEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 10126 - protein, 1155 aa, Human; identical to SEQ ID NO: 10125

SEQ ID NO: 10127 - protein, 303 aa, Human
VSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFQGAESRTVIRYELNTETVKAEKEIPGAGYHGQFPYSWGGYTDIDLAVDEAGLWVIYSTDEAKGAIVLSKLNPENLELEQTWETNIRKQSVANAFIICGTLYTVSSYTSADATVNFAYDTGTGISKTLTIPFKNRYKYSSMIDYNPLEKKLFAWDNLNMVTYDIKLSKM

SEQ ID NO: 10128 - protein, 637 aa, Human
SELLIHFLQQEKAANMKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 10129 - protein, 605 aa, Human
NSVVRCGQSPLLSGSKMSVSVHENRKSRASSGSINIYLFHKSSYADSVLTHLNLLRQQRLFTDVLLHAGNRTFPCHRAVLAACSRYFEAMFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 10130 - protein, 448 aa, Human
GDICDPNPCENGGICLPGLADGSFSCECPDGFTDPNCSSVVEVGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 10131 - protein, 970 aa, Human
ASRGAGRANMLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 10132 - protein, 579 aa, Human
LETVHVWIREHFHYGTGYKHTPGRLQESQTEEKAFPSAATAAAAAFESPLLSWFFLPNQRHLRCCRCSLWCHSAAGQRMRLPKLLTFLLWYLAWLDLEFICTVLGAPDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPAALLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARCSRKALHVNFKDMGWDDWIIAPLEYEAFHCEGLCEFPLRSHLEPTNHAVIQTLMNSMDPESTPPTCCVPTRLSPISILFIDSANNVVYKQYEDMVVESCGCR

SEQ ID NO: 10133 - protein, 1050 aa, Human
DYMQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGKRPVSYQHLSNSMAQKRNYENFIGNAHYRPNDKKT

SEQ ID NO: 10134 - protein, 536 aa, Human
HLVPTSPHPILLPSRAPVSPAAMSSPISKSRSLAAFLQQLRSPRQPPRLVTSTAYTSPQPREVPVCPLTAGGETQNAAALPGPTSWPLLGSLLQILWKGGLKKQHDTLVEYHKKYGKIFRMKLGSFESVHLGSPCLLEALYRTESAYPQRLEIKPWKAYRDYRKEGYGLLILEGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQDHTLAWDTIFKSVKACIDNRLEKYSQQPSADFLCDIYHQNRLSKKELYAAVTELQLAAVETTANSLMWILYNLSRNPQVQQKLLKEIQSVLPENQVPRAEDLRNMPYLKACLKESMRLTPSVPFTTRTLDKATVLGEYALPKGTVLMLNTQVLGSSEDNFEDSSQFRPERWLQEKEKINPFAHLPFGVGKRMCIGRRLAELQLHLALCWIVRKYDIQATDNEPVEMLHSGTLVPSRELPIAFCQR

SEQ ID NO: 10135 - protein, 459 aa, Human
ARRGLERQTAQWAEKEAQQPPWPVMEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 10136 - protein, 246 aa, Human
QVRSLNFRMLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 10137 - protein, 345 aa, Human
LPVRAEPTRAAAMSGDEMIFDPTMSKKKKKKKKPFMLDEEGDTQTEETQPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 10138 - protein, 676 aa, Human
PVLRTHPGPQSLPRVPGVPCGGLLEPLSRAEVSPRLGLRRDLLGGMAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRTAH

SEQ ID NO: 10139 - protein, 240 aa, Human
CPFCFSQSPRIMKVASGSTATAAAGPSCALKAGKTASGAGEVVRCLSEQSVAISRCAGGAGARLPALLGRAAGKRAALRHERLLLTPQGAGAHPAPEPQGEQGGDSPARHRLHQGPSVGAELGIRSWNPRGPRAAGPGSAQHPQRRDQRPDGRGGMRSCGRSHLVSLKRLPQGPADPSHPGGKRNYVLCGSPPTRLAGSEGEQDRSAATAPLTASSLGLRLRHWRGEGAPLCTPTSHQRL

SEQ ID NO: 10140 - protein, 705 aa, Human
SHLEGLAASGRSHRPRPTMAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 10141 - protein, 1312 aa, Human
RRRCACSRAVLACAAAAPSVGAMAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKENGDLSPFSGTSLRERGSDASGQLFHGRAREGSFESRYQQPFEDFRISQEHLADHFDSRERRAPRRTRVNGDNRL

SEQ ID NO: 10142 - protein, 591 aa, Human
KLFTCICSLLLKVTMSQVQVQVQNPSAALSGSQILNKNQSLLSQPLMSIPSTTSSLPSENAGRPIQNSALPSASITSTSAAAESITPTVELNALCMKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 10143 - protein, 591 aa, Human; identical to SEQ ID NO: 10142

SEQ ID NO: 10144 - protein, 591 aa, Human; identical to SEQ ID NO: 10142

SEQ ID NO: 10145 - protein, 591 aa, Human; identical to SEQ ID NO: 10142

SEQ ID NO: 10146 - protein, 453 aa, Human
WVRDREGHIRSRRSMKMLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 10147 - protein, 649 aa, Human
KLRSVQIYIQQGSHFNQQLLLHYFSKMNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAGNLGSYATYNQSGYIPSFLKKEVQSAGQRIHLAPLNATASEYTWNTKTGRGQFSGRTYNPTAKNLNIVNRAQPIPSVHGRTDWVAKYGGHR

SEQ ID NO: 10148 - protein, 336 aa, Human
GAGNESCTLAGEGMSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 10149 - protein, 336 aa, Human; identical to SEQ ID NO: 10148

SEQ ID NO: 10150 - protein, 392 aa, Human
GDGGNMSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 10151 - protein, 500 aa, Human
PPPGPLAMALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 10152 - protein, 1318 aa, Human
APAPPLLLRGVLKQPGEVEPPPGSPTSRTPPASAALRGHSMTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHIKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 10153 - protein, 563 aa, Human
STPPSPISSSSSSCSRGGERGPGGASNCGTPQLDTEAAAGPPARSLLLSSYASHPFGAPHGPSAPGVAGPGGNLSSWEDLLLFTDLDQAATASKLLWSSRGAKLSPFAPEQPEEMYQTLAALSSQGPAAYDGAPGGFVHSAAAAAAAAAAASSPVYVPTTRVGSMLPGLPYHLQGSGSGPANHAGGAGAHPGWPQASADSPPYGSGGGAAGGGAAGPGGAGSAAAHVSARFPYSPSPPMANGAAREPGGYAAAGSGGAGGVSGGGSSLAAMGGREPQYSSLSAARPLNGTYHHHHHHHHHHPSPYSPYVGAPLTPAWPAGPFETPVLHSLQSRAGAPLPVPRGPSADLLEDLSESRECVNCGSIQTPLWRRDGTGHYLCNACGLYSKMNGLSRPLIKPQKRVPSSRRLGLSCANCHTTTTTLWRRNAEGEPVCNACGLYMKLHGVPRPLAMKKEGIQTRKRKPKNINKSKTCSGNSNNSIPMTPTSTSSNSDDCSKNTSPTTQPTASGAGAPVMTGAGESTNPENSELKYSGQDGLYIGVSLASPAEVTSSVRPDSWCALALA

SEQ ID NO: 10154 - protein, 221 aa, Human
CIRQFILERNLTHVMNVARFLVEKHTLHVIIDFILSKVSNQQSNLAQHQRVYTGEKPYKCNEWGKALSGKSSLFYHQAIHGVGKLCKCNDCHKVFSNATTIANHWRIHNEDRSYKCNKCGKIFRHRSYLAVYQRTHTGEKPYKYHDCGKVFSQASSYAKHRRIHTGEKPHKCDDCGKVLTSRSHLIRHQRIHTGHKSYKCLKCGKVFSLWALHAEHQKIHF

SEQ ID NO: 10155 - protein, 472 aa, Human
KGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 10156 - protein, 331 aa, Human
HRQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRWLYWQPILTKMGFMSVILVGAFVGWTLFFQQNAL

SEQ ID NO: 10157 - protein, 268 aa, Human
SSDIMESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPAVKASIPATSAVQNVLINPSLIGSKNILITTNMMSSQNTANESSNALKRKREDDDDDDDDDDDYDNL

SEQ ID NO: 10158 - protein, 193 aa, Human
WRYGSSKCAFSDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 10159 - protein, 332 aa, Human
IPPKERAPGIRASCLAITAGARPTSYGRVGCEGDVRLSPVSPLLAPPDPRLASRWEGRSRMKGKKGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 10160 - protein, 339 aa, Human
VLPPRHLACLRPAAPLRLPPSPARRAMPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 10161 - protein, 145 aa, Human
NMADRLTQLQDAVNSLADQFCNAIGVLQQCGPPASFNNIQTAINKDQPANPTEEYAQLFAALIARTAKDIDVLIDSLPSEESTAALQAASLYKLEEENHEAATCLEDVVYRGDMLLEKIQSALADIAQSQLKTRSGTHSQSLPDS

SEQ ID NO: 10162 - protein, 389 aa, Human
SHLGFPGTWTRLWPSRMSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLARYPLTESQLALVRDIRRRGKNKVAAQNCRKRKLETIVQLERELERLTNERERLLRARGEADRTLEVMRQQLTELYRDIFQHLRDESGNSYSPEEYALQQAADGTIFLVPRGTKMEATD

SEQ ID NO: 10163 - protein, 444 aa, Human
VAGSQVPPVRAQRRSKAFRLLAERGAAAAMLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 10164 - protein, 256 aa, Human
PCSTNPGELLARLIRHCYGRRVNTLLIIDAYIKPFYFRYYFRGSASDLFLFSLFALSGCVVWRKHSWSSRLLNKSRARAETMQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSR

SEQ ID NO: 10165 - protein, 1061 aa, Human
EGQKKTKAAVRPTVPGAAEPPPGEMDLNRIIQALKGTIDPKLRIAAENELNQSYKIINFAPSLLRIIVSDHVEFPVRQAAAIYLKNMVTQYWPDREPPPGEAIFPFNIHENDRQQIRDNIVEGIIRSPDLVRVQLTMCLRAIIKHDFPGHWPGVVDKIDYYLQSQSSASWLGSLLCLYQLVKTYEYKKAEEREPLIIAMQIFLPRIQQQIVQLLPDSSYYSVLLQKQILKIFYALVQYALPLQLVNNQTMTTWMEIFRTIIDRTVPPETLHIDEDDRPELVWWKCKKWALHIVARLFERYGSPGNVTKEYFEFSEFFLKTYAVGIQQVLLKILDQYRQKEYVAPRVLQQAFNYLNQGVVHSITWKQMKPHIQNISEDVIFSVMCYKDEDEELWQEDPYEYIRMKFDIFEDYASPTTAAQTLLYTAAKKRKEVLPKMMAFCYQILTDPNFDPRKKDGALHVIGSLAEILLKKSLFKDQMELFLQNHVFPLLLSNLGYLRARSCWVLHAFSSLKFHNELNLRNAVELAKKSLIEDKEMPVKVEAALALQSLISNQIQAKEYMKPHVRPIMQELLHIVRETENDDVTNVIQKMICEYSQEVASIAVDMTQHLAEIFGKVLQSDEYEEVEDKTVMAMGILHTIDTILTVVEDHKEITQQLENICLRIIDLVLQKHVIEFYEEILSLAYSLTCHSISPQMWQLLGILYEVFQQDCFEYFTDMMPLLHNYVTIDTDTLLSNAKHLEILFTMCRKVLCGDAGEDAECHAAKLLEVIILQCKGRGIDQCIPLFVQLVLERLTRGVKTSELRTMCLQVAIAALYYNPDLLLHTLERIQLPHNPGPITVQFINQWMNDTDCFLGHHDRKMCIIGLSILLELQNRPPAVDAVVGQIVPSILFLFLGLKQVCATRQLVNREDRSKAEKADMEENEEISSDEEETNVTAQAMQSNNGRGEDEEEEDDDWDEEVLEETALEGFSTPLDLDNSVDEYQFFTQALITVQSRDAAWYQLLMAPLSEDQRTALQEVYTLAEHRRTVAEAKKKIEQQGGFTFENKGVLSAFNFGTVPSNN

SEQ ID NO: 10166 - protein, 252 aa, Human
DKGVSETMDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDMIWDRGALVAINPGDRKCYADTMFSLLGKKFQYLLCVLSYDPTKHPGPPFYVPHAEIERLFGKICNIRCLEKVDAFEERHKSWGIDCLFEKLYLLTEK

SEQ ID NO: 10167 - protein, 498 aa, Human
GTSGRPRICIAEDGTPGQRSRMANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 10168 - protein, 783 aa, Human
QYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQASRHSQRSTFHQSPAHSEEPQYTKCS

SEQ ID NO: 10169 - protein, 831 aa, Human
DAERCPGPLTCTACSEPRGPPARPAENVLATLGPRAPRCAREARARVRKAARRRARGGLFCIMCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 10170 - protein, 786 aa, Human
CGMSDQKKEEEEEAAAAAAMATEGGKTSEPENNNKKPKTSGSQDSQPSPLALLAATCSKIGTPGENQATGQQQIIIDPSQGLVQLQNQPQQLELVTTQLAGNAWQLVASTPPASKENNVSQPASSSSSSSSSNNGSASPTKTKSGNSSTPGQFQVIQVQNPSGSVQYQVIPQLQTVEGQQIQINPTSSSSLQDLQGQIQLISAGNNQAILTAANRTASGNILAQNLANQTVPVQIRPGVSIPLQLQTLPGTQAQVVTTLPINIGGVTLALPVINNVAAGGGTGQVGQPAATADSGTSNGNQLVSTPTNTTTSASTMPESPSSSTTCTTTASTSLTSSDTLVSSADTGQYASTSASSSERTIEESQTPAATESEAQSSSQLQPNGMQNAQDQSNSLQQVQIVGQPILQQIQIQQPQQQIIQAIPPQSFQLQSGQTIQTIQQQPLQNVQLQAVNPTQVLIRAPTLTPSGQISWQTVQVQNIQSLSNLQVQNAGLSQQLTITPVSSSGGTTLAQIAPVAVAGAPITLNTAQLASVPNLQTVSVANLGAAGVQVQGVPVTITSVAGQQQGQDGVKVQQATIAPVTVAVGGIANATIGAVSPDQLTQVHLQQGQQTSDQEVQPGKRLRRVACSCPNCREGEGRGSNEPGKKKQHICHIEGCGKVYGKTSHLRAHLRWHTGERPFICNWMFCGKRFTRSDELQRHRRTHTGEKRFECPECSKRFMRSDHLSKHVKTHQNKKGGGTALAIVTSGELDSSVTEVLGSPRIVTVAAISQDSNPATPNVSTNMEEF

SEQ ID NO: 10171 - protein, 483 aa, Human
EAVRHRGALASQGDPSSHRHHRGRGPDRAPAAPRPPRHPAFLSPSCNQDPSGRWRPREPGLGTHLGLSPPPPESPGMESRKDMVVFLDGGQLGTLVGKRVSNLSEAVGSPLPEPPEKMVPRGCLSPRAVPPATRERGGGGPEEEPVDGLAGSAAGPGAEPQVAGAAMLGPGPPAPSVDSLSGQGQPSSSDTESDFYEEIEVSCTPDCATGNAEYQHSKGSGSEALVGSPNGGSETPKSNGGSGGGGSQGTLACSASDQMRRYRTAFTREQIARLEKEFYRENYVSRPRRCELAAALNLPETTIKVWFQNRRMKDKRQRLAMTWPHPADPAFYTYMMSHAAAAGGLPYPFPSHLPLPYYSPVGLGAASAASAAASPFSGSLRPLDTFRVLSQPYPRPELLCAFRHPPLYPGPAHGLGASAGGPCSCLACHSGPANGLAPRAAAASDFTCASTSRSDSFLTFAPSVLSKASSVALDQREEVPLTR

SEQ ID NO: 10172 - protein, 211 aa, Human
MKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 10173 - protein, 431 aa, Human
AGTMAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 10174 - protein, 557 aa, Human
RLSSWRKMATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 10175 - protein, 106 aa, Human
LSGLGRRSEMTKGTSSFGKRRNKTHTLCRRCGSKAYHLQKSTCGKCGYPAKRKRKYNWSAKAKRRNTTGTGRMRHLKIVYRRFRHGFREGTTPKPKRAAVAASSSS

SEQ ID NO: 10176 - protein, 229 aa, Human
EVLLEPLWLLSAEWKRVLLFVSLAMALQLSREQGITLRGSAEIVAEFFSFGINSILYQRGIYPSETFTRVQKYGLTLLVTTDLELIKYLNNVVEQLKDWLYKCSVQKLVVVISNIESGEVLERWQFDIECDKTAKDDSAPREKSQKAIQDEIRSVIRQITATVTFLPLLEVSCSFDLLIYTDKDLVVPEKWEESGPQFITNSEEVRLRSFTTTIHKVNSMVAYKIPVND

SEQ ID NO: 10177 - protein, 323 aa, Human
VVAMAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 10178 - protein, 354 aa, Human
EGEGRLADTFVSLLLSARGRRRRSIVKVSLHPAVMSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 10179 - protein, 594 aa, Human
RYSHRGSAGAMGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENVVCESPVEIIKSKEVESALQTVDLNEGDAAPEPTEAKLKREESKPRTSLMAFLRQMSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 10180 - protein, 134 aa, Human; identical to SEQ ID NO: 6250

SEQ ID NO: 10181 - protein, 482 aa, Human
AKMAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAWFEEKQQQFENLDQQLRKLHVSVEALVCHRKELSANTAAFAKSAAMLGNSEDHTALSRALSQLAEVEEKIDQLHQEQAFADFYMFSELLSDYIRLIAAVKGVFDHRMKCWQKWEDAQITLLKKREAEAKMMVANKPDKIQQAKNEIREWEAKVQQGERDFEQISKTIRKEVGRFEA

SEQ ID NO: 10182 - protein, 431 aa, Human
ATSSSSGVNLAKGVMRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 10183 - protein, 230 aa, Human
GHRPTWLAFPLLNGVCCSCPLRALFPGILDFRVGQQAGKMLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIRSNLPCTPVLVVATQTDQREMGPHRASCVNAMEGKKLAQDVRAKGYLECSALSNRGVQQVFECAVRTAVNQARRRNRRRLFSINECKIF

SEQ ID NO: 10184 - protein, 571 aa, Human
AEPQLSEHRVGSRDPSRAGSWDRNLGGPGPTQLTCAGHQHPRNPEARALKVTPLGRKAMAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 10185 - protein, 221 aa, Human
DLATPLAFAHNPSRVWEFYHYRREVMGSKEPNAGHRAIAECETRLGKQGRRVVVITQNIDELHRKAGTKNLLEIHGSLFKTRCTSCGVVAENYKSPICPALSGKGCEEAGCGGLLRPHVVWFGENLDPAILEEVDRELAHCDLCLVVGTSSVVYPAAMFAPQVAARGVPVAEFNTETTPATNRFRYWDTLMGEGDVGGRKKEITVYLRTRPHAEEKWSYGW

SEQ ID NO: 10186 - protein, 368 aa, Human
PRAAPRRRPRPAVAAAAARSRCTMPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVFERNGRKLKLFYGMSSDTAMNKHAGGVAEYRASEGKTVEVPYKGDVENTILDILGGLRSTCTYVGAAKLKELSRRATFIRVTQQHNTVFS

SEQ ID NO: 10187 - protein, 320 aa, Human
YLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 10188 - protein, 201 aa, Human
SFFAASTARMKTILSNQTVDIPENVDITLKGRTVIVKGPRGTLRRDFNHINVELSLLGKKKKRLRVDKWWGNRKELATVRTICSHVQNMIKGVTLGFRYKMRSVYAHFPINVVIQENGSLVEIRNFLGEKYIRRVRMRPGVACSVSQAQKDELILEGNDIELVSNSAALIQQATTVKNKDIRKFLDGIYVSEKGTVQQADE

SEQ ID NO: 10189 - protein, 341 aa, Human
EGKPRTSGAEHSSCRGKASMSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKKSSAGCEGIGDFVELLGGTGLDPSKMTPLADLCYPFHGPAQMKVGCDNTVVRMVSSGKHVNRVTFEYRQLEPYELENPNGNSIGEFCLSGL

SEQ ID NO: 10190 - protein, 1559 aa, Human
IVDDERLSAEEMDERRRQNIAYEYLCHLEEAKRWMEVCLVEELPPTTELEEGLRNGVYLAKLAKFFAPKMVSEKKIYDVEQTRYKKSGLHFRHTDNTVQWLRAMESIGLPKIFYPETTDVYDRKNIPRMIYCIHALSLYLFKLGIAPQIQDLLGKVDFTEEEISNMRKELEKYGIQMPSFSKIGGILANELSVDEAALHAAVIAINEAVEKGIAEQTVVTLRNPNAVLTLVDDNLAPEYQKELWDAKKKKEENARLKNSCISEEERDAYEELLTQAEIQGNINKVNRQAAVDHINAVIPEGDPENTLLALKKPEAQLPAVYPFAAAMYQNELFNLQKQNTMNYLAHEELLIAVEMLSAVALLNQALESNDLVSVQNQLRSPAIGLNNLDKAYVERYANTLLSVKLEVLSQGQDNLSWNEIQNCIDMVNAQIQEENDRVVAVGYINEAIDEGNPLRTLETLLLPTANISDVDPAHAQHYQDVLYHAKSQKLGDSESVSKVLWLDEIQQAVDEANVDEDRAKQWVTLVVDVNQCLEGKKSSDILSVLKSSTSNANDIIPECADKYYDALVKAKELKSERVSSDGSWLKLNLHKKYDYYYNTDSKESSWVTPESCLYKESWLTGKEIEDIIEEVTVGYIRENIWSASEELLLRFQATSSGPILREEFEARKSFLHEQEENVVKIQAFWKGYKQRKEYMHRRQTFIDNTDSIVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 10191 - protein, 193 aa, Human
AGSSCRLTLQLGGMDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 10192 - protein, 593 aa, Human
GRRGRAGAEEGGREPAAAATTATMSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 10193 - protein, 510 aa, Human
QRSWAGPGAGPEAGTRPPARGRRRQPGNVDPRRRAPQLRSQMQVAMARATTATGNRLWPGLLIMLGSLCHRGSPCGLSTHIEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGCPQVGLARPWLCWTLTWTACLTWPWELPRWAPSSSPTKVPCMSTLVPNKEECLLPLTSPFLARTSTVTWAGLSWLQM

SEQ ID NO: 10194 - protein, 1125 aa, Human
IMADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 10195 - protein, 415 aa, Human
RASSPPGFPSQSRTDAQTRAPTRSLLLPHRPKMAALKLLSSGLRLCASARGSGATWYKGCVCSFSTSAHRHTKFYTDPVEAVKDIPDGATVLVGGFGLCGIPENLIDALLKTGVKGLTAVSNNAGVDNFGLGLLLRSKQIKRMVSSYVGENAEFERQYLSGELEVELTPQGTLAERIRAGGAGVPAFYTPTGYGTLVQEGGSPIKYNKDGSVAIASKPREVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLHQCRQGNSYYSSRSLFFLQR

SEQ ID NO: 10196 - protein, 978 aa, Human
AAGSGSRPPAPAARKMADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKATVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 10197 - protein, 560 aa, Human
SMSACWSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 10198 - protein, 454 aa, Human
IPSSGSTEPELSQSVLDAFDLALPKIKILTEGFVDLIFTRPARCLQASRALSRKAQEGSFSPRALIPGRGGRRFRSSMAATEDERLAGSGEGERLDFLRDRHVRFFQRCLQVLPERYSSLETSRLTIAFFALSGLDMLDSLDVVNKDDIIEWIYSLQVLPTEDRSNLNRCGFRGSSYLGIPFNPSKAPGTAHPYDSGHIAMTYTGLSCLVILGDDLSRVNKEACLAGLRALQLEDGSFCAVPEGSENDMRFVYCASCICYMLNNWSGMDMKKAITYIRRSMSYDNGLAQGAGLESHGGSTFCGIASLCLMGKLEEVFSEKELNRIKRWCIMRQQNGYHGRPNKPVDTCYSFWVGATLKLLKIFQYTNFEKNRNYILSTQDRLVGGFAKWPDSHPDALHAYFGICGLSLMEESGICKVHPALNVSTRTSERLLDLHQSWKTKDSKQCSENVHIST

SEQ ID NO: 10199 - protein, 2111 aa, Human
EGQEGTGRWQQGSPAGARPREWRRDTHGFPGPAAALTSASRSGTRRVRDCAGTMDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLSSQNRVVRQNPGERNYHIFYALLAGLEHEEREEFYLSTPENYHYLNQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGTEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 10200 - protein, 369 aa, Human
QALRGPPVCRSRKVAEQDPKVARGSRDDSSPQESCCLLRNMVSKSRWKLLAMLALVLVVMVWYSISREDSFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 10201 - protein, 188 aa, Human
FPAQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 10202 - protein, 770 aa, Human
GLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKVYARMSEVLGITDDNHVLETFMTKIVTNLKYWGRYEPVISRTLQFLNDLSVGYILLKKLVKIDAVKFMLKNHTSEHFPFLGISDNHSLSDFRCRTTFYTALTRLLMVDLGEDEDEFENFMLPLTVAFETVLQIFNNNFKQEDVKRMLIGLARDLRGIAFALNTKTSYTMLFDWMYPTYLPLLQNAVERWYGEPTCTTPILKLMAELMQNRSQRLNFDVSSPNGILLFREASKMVCTYGNQILSLGSLSKDQIYPMKLKGISICYSALKSALCGNYVSFGVFKLYGDNHFDNVLQAFVKMLLSVSHSDLLQYRKLSQSYYPLLECLTQDHMSFIINLEPPVLMYVLTSISEGLTTLDTVVSSSCCTSLDYIVTYLFKHIAKEGKKPLRCREATQAGQRLLHFMQQNPDVLQQMMSVLMNTIVFEDCRNQWSVSRPLLGLILLNEKYFSELRASLINSQPLPKQEVLAQCFRNLMEGVEQNLSVKNRDRFTQNLSVFRRDVAEALRSDGNTEPCSLDMMS

SEQ ID NO: 10203 - protein, 473 aa, Human
ARTHRVLGHPTVSRMAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 10204 - protein, 289 aa, Human
RDEDGTGAGCGQWTRFCREPKMAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 10205 - protein, 780 aa, Human
VVWETPWRVKNKFAGQTMDDWKSRLVIKSMLPHFAMVGNRQEPRKLQESGKKPSWMEEEDLSFLYKSSPGRKHQGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLIRSLTPTSNLLSQQQQQQQQQQQANVIFKPISSNSSKTLSMIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQGCCHLFAWTSAASSVKPQHQHGNSFTSRQDPQPGDVSPSNITHVDKACKLGEARHPQVSLGRQPPSCQALGSESFLPGSSFAHELARVTSSYSTSEAAPWGSWDPKAWRQVPAPLLPSCDATGK

SEQ ID NO: 10206 - protein, 253 aa, Human [sequence omitted]

SEQ ID NO: 10207 - protein, 406 aa, Human
NILESTMNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQIEGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 10208 - protein, 183 aa, Human
EIWMASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 10209 - protein, 502 aa, Human
LPRIHLASVDQLQQDSMVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 10210 - protein, 175 aa, Human
EELQSCLGPQPRLAGAPVSAALLPARGTNMAQKRPACTLKPECVQQLLVCSQEAKKSAYCPYSHFPVGAALLTQEGRIFKGCNIENACYPLGICAERTAIQKAVSEGYKDFRAIAIASDMQDDFISPCGACRQVMREFGTNWPVYMTKPDGTYIVMTVQELLPSSFGPEDLQKTQ

SEQ ID NO: 10211 - protein, 309 aa, Human
QEELLGSKVLKSKNFERTLKPPSSFSRNAVLIPLTRVVLIGGKPDRVVECIKIILDLIYESPIKGRAQPYDPNFYDETYDYGGFTIMFDDRCGRPVGFPMRGRGGFDRMPPGQGGRPMPPSRRDYDDMSPRQGPPPPPPGQGGEGGSRARNLPLPPPPPPRGGDLMAYDRRGRPGDCYHGMVGFSADETWDSAIDTWSPSEWQMAYEPQGGSRYDYSYAGGRGSYGNLGGLIITTQVTIPKDLAGSIIGKGGLQIKQIRHESGASIKIDEPLEGLEDWIITIRETQDQIQNAQYLLQNSVKQCADVEGV

SEQ ID NO: 10212 - protein, 309 aa, Human; identical to SEQ ID NO: 10211

SEQ ID NO: 10213 - protein, 302 aa, Human
GAAVSVKMIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERNVPLATDLIRISQYRFTVSDLMRMEKIVLEKVCWKVKATTAFQFLQLYYSLLQENLPLERRNSINFERLEAQLKACHCRIIFSKAKPSVLALSIIALEIQAQKCVELTEGIECLQKHSKINGRDLTFWQELVSKCLTEYSSNKCSKPNVQKLKWIVSGRTARQLKHSYYRITHLPTIPEMVP

SEQ ID NO: 10214 - protein, 333 aa, Human
MVGREKELSIHFVPGSCRLVEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 10215 - protein, 698 aa, Human
QTEKMAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRSAWPLAKCNTNTSNNTEEEKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 10216 - protein, 358 aa, Human
ASFSSVVTVAEVEGRSEEWRDWLHFLRGSSEPPRSSSGTLLRRALGRPDPTAKVFGDPPRSCWPQEHPSGPNAQWTMPLLTQQIQDEDDQYSLVASLDNVRNLSTILKAIHFREHATCFATKNGIKVTVENAKCVQANAFIQAGIFQEFKVQEESVTFRINLTVLLDCLSIFGSSPMPGTLTALRMCYQGYGYPLMLFLEEGGVVTVCKINTQEPEETLDFDFCSTNVINKIILQSEGLREAFSELDMTSEVLQITMSPDKPYFRLSTFGNAGSSHLDYPKDSDLMEAFHCNQTQVNRYKISLLKPSTKALVLSCKVSIRTDNRGFLSLQYMIRNEDGQICFVEYYCCPDEEVPESES

SEQ ID NO: 10217 - protein, 340 aa, Human
RLARHRKIVEPEVVGESDSEVEGDAWRMEREDSSEEEEEEIDDEEIERRRGMMRQRAQERKNEEMEVMEVEDEGRSGEESESESEYEEYTDSEDEMEPRLKPVFIRKKDRVTVQEREAEALKQKELEQEAKRMAEERRKYTLKIVEEETKKELEENKRSLAALDALNTDDENDEEEYEAWKVRELKRIKRDREDREALEKEKAEIERMRNLTEEERRAELRANGKVITNKAVKGKYKFLQKYYHRGAFFMDEDEEVYKRDFSAPTLEDHFNKTILPKVMQVKNFGRSGRTKYTHLVDQDTTSFDSAWGQESAQNTKFFKQKAAGVRDVFERPSAKKRKTT

SEQ ID NO: 10218 - protein, 502 aa, Human
AVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 10219 - protein, 866 aa, Human [sequence omitted]

SEQ ID NO: 10220 - protein, 195 aa, Human
KIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 10221 - protein, 602 aa, Human [sequence omitted]

SEQ ID NO: 10222 - protein, 915 aa, Human
QKRSENIKQVEVWSILSKMNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 10223 - protein, 545 aa, Human
PPVSSAEPAARPATSLLCSCLCLHSRMDLVGVASPEPGTAAAWGPSKCPWAIPQNTISCSLADVMSEQLAKELQLEEEAAVFPEVAVAEGPFITGENIDTSSDLMLAQMLQMEYDREYDAQLRREEKKFNGDSKVSISFENYRKVHPYEDSDSSEDEVDWQDTRDDPYRPAKPVPTPKKGFIGKGKDITTKHDEVVCGRKNTARMENFAPEFQVGDGIGMDLKLSNHVFNALKQHAYSEERRSARLHEKKEHSTAEKAVDPKTRLLMYKMVNSGMLETITGCISTGKESVVFHAYGGSMEDEKEDSKVIPTECAIKVFKTTLNEFKNRDKYIKDDFRFKDRFSKLNPRKIIRMWAEKEMHNLARMQRAGIPCPTVVLLKKHILVMSFIGHDQVPAPKLKEVKLNSEEMKEAYYQTLHLMRQLYHECTLVHADLSEYNMLWHAGKVWLIDVSQSVEPTHPHGLEFLFRDCRNVSQFFQKGGVKEALSERELFNAVSGLNITADNEADFLAEIEALEKMNEDHVQKNGRKAASFLKDDGDPPLLYDE

SEQ ID NO: 10224 - protein, 311 aa, Human
FAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLCGFFILDCLST

SEQ ID NO: 10225 - protein, 581 aa, Human
PARSRRTRGLSRIVPKSKEFIETESSSSSSSSDSDLESEQEEYPLSKAQTVAASASSGNDQRLKEAAANGGSGPRAPVGSINARTTSDIAKELEEQFYTLVPFGRNELLSPLKDSDEIRSLWVKIDLTLLSRIPEHLPQEPGVLSAPATKDSESAPPSHTSDTPAEKALPKSKRKRKCDNEDDYREIKKSQGEKDSSSRLATSTSNTLSANHCNMNINSVAIPINKNEKMLRSPISPLSDASKHKYTSEDLTSSSRPNGNSLFTSASSSKKPKADSQLQPHGGDLTKAAHNNSENIPLHKSRPQTKPWSPGSNGHRDCKRQKLVFDDMPRSADYFMQEAKRMKHKADAMVEKFGKALNYAEAALSFIECGNAMEQGPMESKSPYTMYSETVELIRYAMRLKTHSGPNATPEDKQLAALCYRCLALLYWRMFRLKRDHAVKYSKALIDYFKNSSKAAQAPSPWGASGKSTGTPSPMSPNPSPASSVGSQGSLSNASALSPSTIVSIPQRIHQMAANHVSITNSILHSYDYWEMADNLAKENREFFNDLDLLMGPVTLHSSMEHLVQYSQQGLHWLRNSAHLS

SEQ ID NO: 10226 - protein, 199 aa, Human
MVSRMVSTMLSGLLFWLASGWTPAFAYSPRTPDRVSEADIQRLLHGVMEQLGIARPRVEYPAHQAMNLVGPQSIEGGAHEGLQHLGPFGNIPNIVAELTGDNIPKDFSEDQGYPDPPNPCPVGKTADDGCLENTPDTAEFSREFQLHQHLFDPEHDYPGLGKWNKKLLYEKMKGGERRKRRRPHSAPRVESAGPEDPPH

SEQ ID NO: 10227 - protein, 199 aa, Human; identical to SEQ ID NO: 10226

SEQ ID NO: 10228 - protein, 420 aa, Human
CPPFSVRVPPWAGLALLPSPSLMALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVGIMDRFLQVQPVSRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSKVAAAASCLSQKVLGQGKWNLKQQYYTGYTENEVLEVMQHMAKNVVKVNENLTKFIAIKNKYASSKLLKISMIPQLNSKAVKDLASPLIGRS

SEQ ID NO: 10229 - protein, 198 aa, Human
PAIAMARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKATSQE

SEQ ID NO: 10230 - protein, 380 aa, Human
DPETMNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 10231 - protein, 202 aa, Human
SMDLSLLWVLLPLVTMAWGQYGDYGYPYQQYHDYSDDGWVNLNRQGFSYQCPQGQVIVAVRSIFSKKEGSDRQWNYACMPTPQSLGEPTECWWEEINRAGMEWYQTCSNNGLVAGFQSRYFESVLDREWQFYCCRYSKRCPYSCWLTTEYPGHYGEEMDMISYNYDYYIRGATTTFSAVERDRQWKFIMCRMTEYDCEFANV

SEQ ID NO: 10232 - protein, 584 aa, Human
RGWRGASGFRGAKPGAPSPAELGASMAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 10233 - protein, 433 aa, Human
GAGGGGGRRRRGRGAAGGAPGAGRVRRTPRTARNMAFWGWRAAAALRLWGRVVERVEAGGGVGPFQACGCRLVLGGRDDVSAGLRGSHGARGEPLDPARPLQRPPRPEVPRAFRRQPRAAAPSFFFSSIKGGRRSISFSVGASSVVGSGGSSDKGKLSLQDVAELIRARACQRVVVMVGAGISTPSGIPDFRSPGSGLYSNLQQYDLPYPEAIFELPFFFHNPKPFFTLAKELYPGNYKPNVTHYFLRLLHDKGLLLRLYTQNIDGLERVSGIPASKLVEAHGTFASATCTVCQRPFPGEDIRADVMADRVPRCPVCTGVVKPDIVFFGEPLPQRFLLHVVDFPMADLLLILGTSLEVEPFASLTEAVRSSVPRLLINRDLVGPLAWHPRSRDVAQLGDVVHGVESLVELLGWTEEMRDLVQRETGKLDGPDK

SEQ ID NO: 10234 - protein, 417 aa, Human
VSSSSFAVLFFSTCQSCSSRPVRQEHLGCRTMEELDALLEELERSTLQDSDEYSNPAPLPLDQHSRKETNLDETSEILSIQDNTSPLPAQLVYTTNIQELNVYSEAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 10235 - protein, 126 aa, Human
RFPSYTSLEWLSWFLLCCPLWGWQPCEERRLPASSSYTLLHSPIFLFVILISSLGKVLLICLDPFVFSDLLGAVEYLVDHNSGKGSSFPLVSKDEVAAKTPLFCPQLAYSRPRSSYSLSILGFDLC

SEQ ID NO: 10236 - protein, 153 aa, Human
MRRTGAPAQADSRGRGRARGGCPGGEATLSQPPPRGGTRGQEPQMKETIMNQEKLAKLQAQVRIGGKVNMFTNQGTVIHFNNPKVQASLAANTFTITGHAETKQLTEMLPSILNQLGADSLTSLRRLAEALPKQSVDGKAPLATGEDDDDEVP

SEQ ID NO: 10237 - protein, 2522 aa, Human
ALGEGGGGGGARRQRRGDAGGGAETAPSEIILSPAAEERSGRSETLRRGTAAGRMATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 10238 - protein, 199 aa, Human
KLVECELCRNTHIQETPKKRKTRMTRNGKAPVHLNPLCSSLGSSPGVTKISPRRLRRWLTRSRMPPWTSILPQEPSTSSSHASEPGVHQPAPWPRLCCTWYFPDRENQQFRPNPTLLGNLRQNQVLCPLPYISIFKTRNSSSPNLVYGESGWMSFEDHCAPRGAISRICQDPRKILALVLFQQSPDVLVYGLKNKKAHI

SEQ ID NO: 10239 - protein, 638 aa, Human
IRRQGGIQLLVDLLDHRMTEVHRSACGALRNLVYGKANDDNKIALKNCGGIPALVRLLRKTTDLEIRELVTGVLWNLSSCDALKMPIIQDALAVLTNAVIIPHSGWENSPLQDDRKIQLHSSQVLRNATGCLRNVSSAGEEARRRMRECDGLTDALLYVIQSALGSSEIDSKTVENCVCILRNLSYRLAAETSQGQHMGTDELDGLLCGEANGKDAESSGCWGKKKKKKKSQDQWDGVGPLPDCAEPPKGIQMLWHPSIVKPYLTLLSECSNPDTLEGAAGALQNLAAGSWKWSVYIRAAVRKEKGLPILVELLRIDNDRVVCAVATALRNMALDVRNKELIGKYAMRDLVHRLPGGNNSNNTASKAMSDDTVTAVCCTLHEVITKNMENAKALRDAGGIEKLVGISKSKGDKHSPKVVKAASQVLNSMWQYRDLRSLYKKDGWSQYHFVASSSTIERDRQRPYSSSRTPSISPVRVSPNNRSASAPASPREMISLKERKTDYECTGSNATYHGAKGEHTSRKDAMTAQNTGISTLYRNSYGAPAEDIKHNQVSAQPVPQEPSRKDYETYQPFQNSTRNYDESFFEDQVHHRPPASEYTMHLGLKSTGNYVDFYSAARPYSELNYETSHYPASPDSWV

SEQ ID NO: 10240 - protein, 465 aa, Human
DPGFNWRLFWGTPDAMLWKITDNVKYEEDCEDRHDGSSNGNPRVPHLSSAGQHLYSPAPPLSHTGVAEYQPPPYFPPPYQQLAYSQSADPYSHLGEAYAAAINPLHQPAPTGSQQQAWPGRQSQEGAGLPSHHGRPAGLLPHLSGLEAGAVSARRDAYRRSDLLLPHAHALDAAGLAENLGLHDMPHQMDEVQNVDDQHLLLHDQTVIRKGPISMTKNPLNLPCQKELVGAVMNPTEVFCSVPGRLSLLSSTSKYKVTVAEVQRRLSPPECLNASLLGGVLRRAKSKNGGRSLREKLDKIGLNLPAGRRKAAHVTLLTSLVEGEAVHLARDFAYVCEAEFPSKPVAEYLTRPHLGGRNEMAARKNMLLAAQQLCKEFTELLSQDRTPHGTSRLAPVLETNIQNCLSHFSLITHGFGSQAICAAVSALQNYIKEALIVIDKSYMNPGDQSPADSNKTLEKMEKHRK

SEQ ID NO: 10241 - protein, 669 aa, Human
VTEKTSSLPSQGISMTECFLPPTSSPSEHRRVEHGSGLTRTPSSEEISPTKFPGLYRTGEPSPPHDILHEPPDVVSDDEKDHGKKKGKFKKKEKRTEGYAAFQEDSSGDEAESPSKMKRSKGIHVFKKPSFSKKKEKDFKIKEKPKEEKHKEEKHKEEKHKEKKSKDLTAADVVKQWKEKKKKKKPIQEPEVPQIDVPNLKPIFGIPLADAVERTMMYDGIRLPAVFRECIDYVEKYGMKCEGIYRVSGIKSKVDELKAAYDREESTNLEDYEPNTVASLLKQYLRDLPENLLTKELMPRFEEACGRTTETEKVQEFQRLLKELPECNYLLISWLIVHMDHVIAKELETKMNIQNISIVLSPTVQISNRVLYVFFTHVQELFGNVVLKQVMKPLRWSNMATMPTLPETQAGIKEEIRRQEFLLNCLHRDLQGGIKDLSKEERLWEVQRILTALKRKLREAKRQECETKIAQEIASLSKEDVSKEEMNENEEVINILLAQENEILTEQEELLAMEQFLRRQIASEKEEIERLRAEIAEIQSRQQHGRSETEEYSSESESESEDEEELQIILEDLQRQNEELEIKNNHLNQAIHEEREAIIELRVQLRLLQMQRAKAEQQAQEDEEPEWRGGAVQPPRDGVLEPKAAKEQPKAGKEPAKPSPSRDRKETSI

SEQ ID NO: 10242 - protein, 1022 aa, Human
DFVSQPSRSRALGFVSSHLARAPGGWGGGASSKRRWDPGPDDLGAAPGPGSPTTSSPPPLPRASTGSPARAAPCSPGSPGGRGGGGDHKMADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 10243 - protein, 388 aa, Human
FGAVCRDDNTDKIHSLLVPAHLESSARPQLQKAQRQKVNSFMTLDHQIINPTLKWSQPAVPSGGPLVQHAHTTLDSDAGLTENPLTKLLAIGKEDDNAQWHMEDVIEDIIGMESSFKEEGADSPLLMQRTLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 10244 - protein, 292 aa, Human
FVARRKMADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETALRAYVKEHYPNGVCTVYGKKIDGQQTIIACIESHQFQAKNFWNGRWRSEWKFTITPSTTQVVGILKIQVHYYEDGNVQLVSHKDIQDSLTVSNEVQTAKEFIKIVEAAENEYQTAISENYQTMSDTTFKALRRQLPVTRTKIDWNKILSYKIGKEMQNA

SEQ ID NO: 10245 - protein, 284 aa, Human
SEWFFCATAARIGDPSASTTMPRSFLVRKPSDPNRKPNYSELQDSNPEFTFQQPYDQAHLLAAIPPPEILNPTASLPMLIWDSVLAPQAQPIAWASLRLQESPRVAELTSLSDEDSGKGSQPPSPPSPAPSSFSSTSVSSLEAEAYAAFPGLGQVPKQLAQLSEAKDLQARKAFNCKYCNKEYLSLGALKMHIRSHTLPCVCGTCGKAFSRPWLLQGHVRTHTGEKPFSCPHCSRAFADRSNLRAHLQTHSDVKKYQCQACARTFSRMSLLHKHQESGCSGCPR

SEQ ID NO: 10246 - protein, 351 aa, Human
AVNTYLFMMQAQGILIRDNVRTIGAQVYEQVLRSAYAKRNSSVNDSDYPLDLNHSETFLQTTTFLPEDFTYFANHTCPERLPSMKGPIDINMSEIGMDYIHELFSKDPTIKLGGHWKPSDCMPRWKVAILIPFRNRHEHLPVLFRHLLPMLQRQRLQFAFYVVEQVGTQPFNRAMLFNVGFQEAMKDLDWDCLIFHDVDHIPESDRNYYGCGQMPRHFATKLDKYMYLLPYTEFFGGVSGLTVEQFRKINGFPNAFWGWGGEDDDLWNRVQNAGYSVSRPEGDTGKYKSIPHHHRGEVQFLGRYALLRKSKERQGLDGLNNLNYFANITYDALYKNITVNLTPELAQVNEY

SEQ ID NO: 10247 - protein, 244 aa, Human
ITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQNSYSIKVVLQELRRLMMSKENMKLPQPPEGQCYSN

SEQ ID NO: 10248 - protein, 244 aa, Human; identical to SEQ ID NO: 10247

SEQ ID NO: 10249 - protein, 258 aa, Human
LKMAAAVGRLLRASVARHVSAIPWGISATAALRPAACGRTSLTNLLCSGSSQAKLFSTSSSCHAPAVTQHAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 10250 - protein, 604 aa, Human; identical to SEQ ID NO: 6585

SEQ ID NO: 10251 - protein, 478 aa, Human
PGLCRQRRPGAERDRALAEACRHGPAPPPPPVTRAARAVSVMALAGAPAGGPCAPALEALLGAGALRLLDSSQIVIISAAQDASAPPAPTGPAAPAAGPCDPDLLLFATPQAPRPTPSAPRPALGRPPVKRRLDLETDHQYLAESSGPARGRGRHPGKGVKSPGEKSRYETSLNLTTKRFLELLSHSADGVVDLNWAAEVLKVQKRRIYDITNVLEGIQLIAKKSKNHIQWLGSHTTVGVGGRLEGLTQDLRQLQESEQQLDHLMNICTTQLRLLSEDTDSQRLAYVTCQDLRSIADPAEQMVMVIKAPPETQLQAVDSSENFQISLKSKQGPIDVFLCPEETVGGISPGKTPSQEVTSEEENRATDSATIVSPPPSSPPSSLTTDPSQSLLSLEQEPLLSRMGSLRAPVDEDRLSPLVAADSLLEHVREDFSGLLPEEFISLSPPHEALDYHFGLEEGEGIRDLFDCDFGDLTPLDF

SEQ ID NO: 10252 - protein, 453 aa, Human
PELFMEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISVKKEDVNLMMSSGQILGIRFLDKLCSQKRDVSSPDENNGQSKSKYCLKINRPIGDAADTQDDDVEEIGDQDDSPSDDTVEGTPPSQEDGKSPTTTLRVQEAILKELGSEEVRKVNCYGQEVESMETPESKDLGSQTPQALTFNDGMSEVKDEQTPGWTTAASDMKFEYLLYGHHREQIACQACGKTFSDEGRLRKHEKLHTADRPFVCEMCTKGFTTQAHLKEHLKIHTGYKPYSCEVCGKSFIRAPDLKKHERVHSNERPFACHMCDKAFKHKSHLKDHERRHRGEKPFVCGSCTKAFAKASDLKRHENNMHSERKQVTPSAIQSETEQLQAAAMAAEAEQQLETIACS

SEQ ID NO: 10253 - protein, 578 aa, Human
RAPDPSLSPAPVLCGSPLTALHSPDPGAGPGPCRPWRPDAPKLPLLRSHQHHPDLGAGARDGRGPVRAQRARRPGPTMAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 10254 - protein, 261 aa, Human
FQLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 10255 - protein, 378 aa, Human
LTAGTAMNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 10256 - protein, 150 aa, Human
VRKMAGNSILLAAVSILSACQQSYFALQVGKARLKYKVTPPAVTGSPEFERVFRAQQNCVEFYPIFIITLWMAGWYFNQVFATCLGLVYIYGRHLYFWGYSEAAKKRITGFRLSLGILALLTLLGALGIANSFLDEYLDLNIAKKLRRQF

SEQ ID NO: 10257 - protein, 379 aa, Human
DRADLLPPPSVGPERPAPRSPVRGGRAEPRGGAAPPSPLPPPPPPAAEDADGPRRRLAAPGPGAMVQQRGARAKRDGGPPPPGPGPAEEGAREPGWCKTPSGHIKRPMNAFMVWSQHERRKIMDQWPDMHNAEISKRLGRRWQLLQDSEKIPFVREAERLRLKHMADYPDYKYRPRKKSKGAPAKARPRPPGGSGGGSRLKPGPQLPGRGGRRAAGGPLGGGAAAPEDDDEDDDEELLEVRLVETPGRELWRMVPAGRAARGQAERAQGPSGEGAAAAAAASPTPSEDEEPEEEEEEAAAAEEGEEETVASGEESLGFLSRLPPGPAGLDCSALDRDPDLQPPSGTSHFEFPDYCTPEVTEMIAGDWRPSSIADLVFTY

SEQ ID NO: 10258 - protein, 690 aa, Human
LGVQSINWQKAFNRQAHHTDKFSSQELILRRGQNFQVLMIMNKGLGSNERLEFIVSTGPYPSESAMTKAVFPLSNGSSGGWSAVLQASNGNTLTISISSPASAPIGRYTMALQIFSQGGISSVKLGTFILLFNPWLNVDSVFMGNHAEREEYVQEDAGIIFVGSTNRIGMIGWNFGQFEEDILSICLSILDRSLNFRRDAATDVASRNDPKYVGRVLSAMINSNDDNGVLAGNWSGTYTGGRDPRSWNGSVEILKNWKKSGFSPVRYGQCWVFAGTLNTALRSLGIPSRVITNFNSAHDTDRNLSVDVYYDPMGNPLDKGSDSVWNFHVWNEGWFVRSDLGPSYGGWQVLDATPQERSQGVFQCGPASVIGVREGDVQLNFDMPFIFAEVNADRITWLYDNTTGKQWKNSVNSHTIGRYISTKAVGSNARMDVTDKYKYPEGSDQERQVFQKALGKLKPNTPFAATSSMGLETEEQEPSIIGKLKVAGMLAVGKEVNLVLLLKNLSRDTKTVTVNMTAWTIIYNGTLVHEVWKDSATMSLDPEEEAEHPIKISYAQYEKYLKSDNMIRITAVCKVPDESEVVVERDIILDNPTLTLEVLNEARVRKPVNVQMLFSNPLDEPVRDCVLMVEGSGLLLGNLKIDVPTLGPKERSRVRFDILPSRSGTKQLLADFSCNKFPAIKAMLSIDVAE

SEQ ID NO: 10259 - protein, 230 aa, Human
ARLPRSTRARTRRPGLRAVPLPVGGFLGKMKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 10260 - protein, 505 aa, Human
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 10261 - protein, 505 aa, Human; identical to SEQ ID NO: 10260

SEQ ID NO: 10262 - protein, 505 aa, Human; identical to SEQ ID NO: 10260

SEQ ID NO: 10263 - protein, 641 aa, Human
SPSGGGYETWGSAQKNFGSARGTRDQAETRGASPGRGSGSRPEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 10264 - protein, 577 aa, Human
ETFLLQPPSQSREAAAPAAPSEPLPGSSPVRGRARTPARRPALAVQLRPRGGGEVAPVRRRLAPRHPQSGPRGTMTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 10265 - protein, 987 aa, Human
FGSAMPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEVIVLAPTVYLGASNYRT

SEQ ID NO: 10266 - protein, 893 aa, Human
LKFLWSCSFLVLPKSINFGDYTFLLIKKLPSLIRQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSKKMTLDLNDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLNKSPSVDHLLSIKKTLKSLKALLRWKLVEKSNLEESDDPDGSQIEKIKEEITQLRNNVFQEIYHEREEYEMLTSLAQKWFPELPLLHPEIGLLKYMNSGGLLTMSLERDLLDAEPMKELSSKRPLVRSEVNGQIILLKGYSVDVDTEAKVIERAATYHRAWREAEGDSGLLPLIFLFLCKSDPMAYLMVPYYPRANLNAVQANMPLNSEETLKVMKGVAQGLHTLHKADIIHGSLHQNNVFALNREQGIVGDFDFTKSVSQRASVNMMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNGEANFDC

SEQ ID NO: 10267 - protein, 893 aa, Human; identical to SEQ ID NO: 10266

SEQ ID NO: 10268 - protein, 747 aa, Human
ADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 10269 - protein, 220 aa, Human
EGLKAPGSLPPALGNPWPCGDMNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 10270 - protein, 304 aa, Human
GIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 10271 - protein, 849 aa, Human
DCKQSGLGRRQKTSRVTEEMANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGVQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 10272 - protein, 647 aa, Human
DRGSSDTHLRDPVFEQLLPKTESISSLNLWVKRTLEVMIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 10273 - protein, 678 aa, Human
AEGSTMDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 10274 - protein, 364 aa, Human
CCRCLGPSPSLLVLLPQEPGGSGTPVRAGAGAGMWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 10275 - protein, 186 aa, Human
AGRCRWDHGGQSGRMASGFKKPSAASTGQKRKVAPKPELTEDQKQEVREAFDLFDVDGSGTIDAKELKVAMRALGFEPRKEEMKKMISEVDREGTGKISFNDFLAVMTQKMSEKDTKEEILKAFRLFDDDETGKISFKNLKRVANELGENLTDEELQEMIDEADRDGDGEVNEEEFLRIMKKTSLY

SEQ ID NO: 10276 - protein, 243 aa, Human
MGKNKQPRGQQRQGGPPAADAAGPDDMEPKKGTGAPKECGEEEPRTCCGCRFPLLLALLQLALGIAVTVVGFLMASISSSLLVRDTPFWAGIIVCLVAYLGLFMLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQVFYVGVRICSLTASEGPQQKI

SEQ ID NO: 10277 - protein, 526 aa, Human
ALKRESERETGDAQIPPRSPKPTVPQIIVQSPKNRNRGNEQQLNMDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 10278 - protein, 117 aa, Human
LRNEMAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWQGPWTSCY

SEQ ID NO: 10279 - protein, 193 aa, Human
ASGSSRPRAMAAAGGARLLRAASAVLGGPAGRWLHHAGSRAGSSGLLRNRGPGGSAEASRSLSVSARARSSSEDKITVHFINRDGETLTTKGKVGDSLLDVVVENNLDIDGFGACEGTLACSTCHLIFEDHIYEKLDAITDEENDMLDLAYGLTDRSRLGCQICLTKSMDNMTVRVPETVADARQSIDVGKTS

SEQ ID NO: 10280 - protein, 2516 aa, Human
TMSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKASRRNEDSNI

SEQ ID NO: 10281 - protein, 116 aa, Human
GAATAAAAVRPTADSETSGSRQTLFLDHPPTILGTMAAVAAASAELLIIGWYIFRVLLQVFLECCIYWVGFAFRNPPGTQPIARSEVFRYSLQKLAYTVSRTGRQVLGERRQRAPN

SEQ ID NO: 10282 - protein, 537 aa, Human
TMGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 10283 - protein, 642 aa, Human
QGSARGVGFGLEVAMGRGSGTFERLLDKATSQLLLETDWESILQICDLIRQGDTQAKYAVNSIKKKVNDKNPHVALYALEVMESVVKNCGQTVHDEVANKQTMEELKDLLKRQVEVNVRNKILYLIQAWAHAFRNEPKYKVVQDTYQIMKVEGHVFPEFKESDAMFAAERAPDWVDAEECHRCRVQFGVMTRKHHCRACGQIFCGKCSSKYSTIPKFGIEKEVRVCEPCYEQLNRKAEGKATSTTELPPEYLTSPLSQQSQLPPKRDETALQEEEELQLALALSQSEAEEKERLRQKSTYTSYPKAEPMPSASSAPPASSLYSSPVNSSAPLAEDIDPELARYLNRNYWEKKQEEARKSPTPSAPVPLTEPAAQPGEGHAAPTNVVENPLPETDSQPIPPSGGPFSEPQFHNGESEESHEQFLKALQNAVTTFVNRMKSNHMRGRSITNDSAVLSLFQSINGMHPQLLELLNQLDERRLYYEGLQDKLAQIRDARGALSALREEHREKLRRAAEEAERQRQIQLAQKLEIMRQKKQEYLEVQRQLAIQRLQEQEKERQMRLEQQKQTVQMRAQMPAFPLPYAQASPGHARSRRRALPALGTSQLPQHLQPCRLGGGLPNARRVHEPAGPCRWPLPQHAQHCG

SEQ ID NO: 10284 - protein, 121 aa, Human
PALTAQPPETRPALDRSRRESRSQGCRGVSVSLTMNLEPPKAEFRSATRVAGGPVTPRKGPPKFKQRQTRQFKSKPPKKGVQGFGDDIPGMEGLGTDITVICPWEAFNHLELHELAQYGII

SEQ ID NO: 10285 - protein, 773 aa, Human
KNKGSLQFEDKWDFMRPIVLKLLRQESVTKQQWFDLFSDVHAVCLWDDKGPAKIHQALKEDILEFIKQAQARVLSHQDDTALLKAYIVEWRKFFTQCDILPKPFCQLEITLMGKQGSNKKSNVEDSIVRKLMLDTWNESIFSNIKNRLQDSAMKLVHAERLGEAFDSQLVIGVRESYVNLCSNPEDKLQIYRDNFEKAYLDSTERFYRTQAPSYLQQNGVQNYMKYADAKLKEEEKRALRYLETRRECNSVEALMECCVNALVTSFKETILAECQGMIKRNETEKLHLMFSLMDKVPNGIEPMLKDLEEHIISAGLADMVAAAETITTDSEKYVEQLLTLFNRFSKLVKEAFQDDPRFLTARDKAYKAVVNDATIFKLELPLKQKGVGLKTQPESKCPELLANYCDMLLRKTPLSKKLTSEEIEAKLKEVLLVLKYVQNKDVFMRYHKAHLTRRLILDISADSEIEENMVEWLREVGMPADYVNKLARMFQDIKVSEDLNQAFKEMHKNNKLALPADSVNIKILNAGAWSRSSEKVFVSLPTELEDLIPEVEEFYKKNHSGRKLHWHHLMSNGIITFKNEVGQYDLEVTTFQLAVLFAWNQRPREKISFENLKLATELPDAELRRTLWSLVAFPKLKRQVLLYEPQVNSPKDFTEGTLFSVNQEFSLIKNAKVQKRGKINLIGRLQLTTERMREEENEGIVQLRILRTQEAIIQIMKMRKKISNAQLQTELVEILKNMFLPQKKMIKEQIEWLIEHKYIRRDESDINTFIYMA

SEQ ID NO: 10286 - protein, 486 aa, Human
HWESRMGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 10287 - protein, 895 aa, Human
NYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLETTYPQTACPKSDSELEVKPAESLLRSESHMEWTWGGFPESTKVSKRERSDHHPRTATITPSENTHFRVIPSEDNLISEVEKDASMEDTVCTIVKPKPRALGTQMSDPTSVAELLEPPLESTQISSMLDADHLPNAALAEAPSESKPAAKVDSPSKKKGVHKRSQHQGPDDIYLDDLKGLEPEVAALYFPKSESEPGSRQWPESDTLSGSQSPQSVGSAAADSGTECLSDSAMDLPDVTLSLCGGLSENGEISKEKFMEHIITYHEFAENPGLIDNPNLVIRIYNRYYNWALAAPMILSLQVFQKSLPKATVESWVKDKMPKKSGRWWFWRKRESMTKQLPESKEGKSEAPPASDLPSSSKEPAGARPAENDSSSDEGSQELEESITVDPIPTEPLSHGSTTSYKKSLRLSSDQIAKLKLHDGPNDVVFSITTQYQGTCRCAGTIYLWNWNDKIIISDIDGTITKSDALGQILPQLGKDWTHQGIAKLYHSINENGYKFLYCSARAIGMADMTRGYLHWVNDKGTILPRGPLMLSPSSLFSAFHREVIEKKPEKFKIECLNDIKNLFAPSKQPFYAAFGNRPNDVYAYTQVGVPDCRIFTVNPKGELIQERTKGNKSSYHRLSELVEHVFPLLSKEQNSAFPCPEFSSFCYWRDPIPEVDLDDLS

SEQ ID NO: 10288 - protein, 513 aa, Human
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQGHCSQMCHNVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 10289 - protein, 260 aa, Human
MASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHPKFIPEFIRKQKEGNFDIVSGTRYKGNGGVYGWDLKRKIISRGANFLTQILLRPGASDLTGSFRLYRKEVLEKLIEKCVSKGYVFQMEMIVRARQLNYTIGEVPISFVDRVYGESKLGGNEIVSFLKGLLTLFATT

SEQ ID NO: 10290 - protein, 535 aa, Human [sequence omitted]

SEQ ID NO: 10291 - protein, 212 aa, Human
HPGRLRGCEREEAGWRHGRAGTRGGRRTGGGKRPRQGSWQPAPEQRWDHLVLNLTLSKKAGRETFCPLPEGEPWHWPSSLFSELHVPDKPGQTEKAPQRPLWPPLRESPLPTPTGFTFPPPSHRAQVHFQDTVTTRCYLLSWRRDLGGACPTVSSPHRNAPLASGPGRDPVPTPTPPLQPNLLGPDLLVPFLENTFKLFKNFKPFFSRYGES

SEQ ID NO: 10292 - protein, 394 aa, Human
RWPQGKPSGHRAGRDPPSGGGGSSAGAHEGTMAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 10293 - protein, 471 aa, Human
SKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 10294 - protein, 254 aa, Human
SAGDMRGTPKTHLLAFSLLCLLSKVRTQLCPTPCTCPWPPPRCPLGVPLVLDGCGCCRVCARRLGEPCDQLHVCDASQGLVCQPGAGPGGRGALCLLAEDDSSCEVNGRLYREGETFQPHCSIRCRCEDGGFTCVPLCSEDVRLPSWDCPHPRRVEVLGKCCPEWVCGQGGGLGTQPLPAQGPQFSGLVSSLPPGVPCPEWSTAWGPCSTTCGLGMATRVSNQNRFCRLETQRRLCLSRPCPPSRGRSPQNSAF

SEQ ID NO: 10295 - protein, 238 aa, Human
GPVGLSLASTVFGRNRSGDGLPASDRPPISSPLATSGTIFSAISCFWDLPAPFLSLAPSWRPTMSSQIRQNYSTDVEAAVNSLVNLYLQASYTYLSLGFYFDRDDAALEGVSHFFRELTEEKREGYERLLKMQNQRGGRALFQDIKKPAEDEWGKTPDAMKAAMALEKKLNQALLDLHALDSAHMDPHLCDFLETHFLDEEVKLIKKMGDHLTNLHRLGGPEAGLGEYLFERLTLKHV

SEQ ID NO: 10296 - protein, 714 aa, Human
QEARWFSGAAPSRLPPAPRFSGPAAIFLSAQGPPSGAMQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEEAGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 10297 - protein, 1254 aa, Human
SRDAAAAGAAATAAPAAAPARTAAAASRVPAARGAAMRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 10298 - protein, 662 aa, Human
RKLPCIKTSTLLTMISAAWSIFLIGTKIGLFLQVAPLSVMAKSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDQQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLPLAAIIGGAVALVTIALLALVCWYVHRNGSLFSRNCAYSKGRRRKDDYAEAGTKKDNSILEIRETSFQMLPISNEPISKEEFVIHTIFPPNGMNLYKNNHSESSSNRSYRDSGIPDSDHSHS

SEQ ID NO: 10299 - protein, 205 aa, Human
GILRIKMSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNWFNVTGSDKCVFLKNTEVSSMECEKNLYWICNKPYK

SEQ ID NO: 10300 - protein, 193 aa, Human
GKMHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 10301 - protein, 130 aa, Human
NSRKTLTAVLAKKNGLGTGATVTSFPVNRKLGTKVGISVLLRNPACFSFKTQMNWHDFMSSSQQFYWIGLSYSEEHTAWLWENGSALSQYLFPSFETFNTKNCIAYNPNGNALDESCEDKNRYICKQQLI

SEQ ID NO: 10302 - protein, 130 aa, Human; identical to SEQ ID NO: 10301

SEQ ID NO: 10303 - protein, 130 aa, Human; identical to SEQ ID NO: 10301

SEQ ID NO: 10304 - protein, 130 aa, Human; identical to SEQ ID NO: 10301

SEQ ID NO: 10305 - protein, 665 aa, Human; identical to SEQ ID NO: 6037

SEQ ID NO: 10306 - protein, 182 aa, Human
VDTNVPTGDGEPARPGSPGSAQGSCSWEQTSRAGFEARPKRTPEMKGLLPLAWFLACSVPAVQGGLLDLKSMIEKVTGKNALTNYGFYGCYCGWGGRGTPKDGTDWCCWAHDHCYGRLEEKGCNIRTQSYKYRFAWGVVTCEPGPFCHVNLCACDRKLVYCLKRNLRSYNPQYQYFPNILCS

SEQ ID NO: 10307 - protein, 174 aa, Human
KRDQGLALLLVLMRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 10308 - protein, 299 aa, Human
EMERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKEK

SEQ ID NO: 10309 - protein, 299 aa, Human; identical to SEQ ID NO: 10308

SEQ ID NO: 10310 - protein, 200 aa, Human
VGLGSAAMGKQNSKLRPEMLQDLRENTEFSELELQEWYKGFLKDCPTGILNVDEFKKIYANFFPYGDASKFAEHVFRTFDTNSDGTIDFREFIIALSVTSRGRLEQKLMWAFSMYDLDGNGYISREEMLEIVQAIYKMVSSVMKMPEDESTPEKRTEKIFRQMDTNNDGKLSLEEFIRGAKSDPSIVRLLQCDPSSASQF

SEQ ID NO: 10311 - protein, 369 aa, Human
ILLLGDLLLALNFSSSPSPALVMALLFSLILAICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 10312 - protein, 414 aa, Human
GQAITSEMVNEYKKILLLKGFELMDDYHFTSIKSLLAYDLGLTTKMQEEYNRIKITDLMEKKFQGVACLDKLIELAKDMPSLKNLVNNLRKEKSKVAKKIKTQEKAPVKKINQEEVGLAAPAPTARNKLTSEARGRIPVAQKRKTPNKEKTEAKRNKVSQEQSKPPGPSGASTSAAVDHPPLPQTSSSTPSNTSFTPNQETQAQRQVDARRNVPQNDPVTVVVLKATAPFKYESPENGKSTMFHATVASKTQYFHVKVFDINLKEKFVRKKVITISDYSECKGVMEIKEASSVSDFNQNFEVPNRIIEIANKTPKISQLYKQASGTMVYGLFMLQKKSVHKKNTIYEIQDNTGSMDVVGSGKWHNIKCEKGDKLRLFCLQLRTVDRKLKLVCGSHSFIKVIKAKKNKEGPMNVN

SEQ ID NO: 10313 - protein, 263 aa, Human
GVQGTVAACGACYWLLGLMAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLDTTSTELSVVESVFKLNEAQPSTIATSMRDSLIDSLT

SEQ ID NO: 10314 - protein, 476 aa, Human
RLHAGSVGSPRRAAAEGGPRALATAAAALASVTRQQGVRMRRSSRPGSASSSRKHTPNFFSENSSMSITSEDSKGLRSAEPGPGEPEGRRARGPSCGEPALSAGVPGGTTWAGSSQQKPAPRSHNWQTACGAATVRGGASEPTGSPVVSEEPLDLLPTLDLRQEMPPPRVFKSFLSLLFQGLSVLLSLAGDVLVSMYREVCSIRFLFTAVSLLSLFLSAFWLGLLYLVSPLENEPKEMLTLSEYHERVRSQGQQLQQLQAELDKLHKEVSTVRAANSERVAKLVFQRLNEDFVRKPDYALSSVGASIDLQKTSHDYADRNTAYFWNRFSFWNYARPPTVILEPHVFPGNCWAFEGDQGQVVIQLPGRVQLSDITLQHPPPSVEHTGGANSAPRDFAVFGLQVYDETEVSLGKFTFDVEKSEIQTFHLQNDPPAAFPKVKIQILSNWGHPRFTCLYRVRAHGVRTSEGAEGSAQGPH

SEQ ID NO: 10315 - protein, 232 aa, Human
LPSSPPGTKEKLYLPSRSPAMNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 10316 - protein, 151 aa, Human
LFPSQVAAAKGAAAMSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMAAIRRASAILRSQKPVMVKRKRTRPTKSS

SEQ ID NO: 10317 - protein, 563 aa, Human
FKALSQYIYTNTHLEREAAFEVAILLRRMEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 10318 - protein, 335 aa, Human
GTAEGTWIAVRRLRLEGTGGEMSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAHCEKTTVFKSLGMAVEDTVAAKLIYDSWSSGK

SEQ ID NO: 10319 - protein, 123 aa, Human
RRRGENDPRTDQSPRAAASRIQHLHPATVVAVTMPKRKAEGDAKGDKAKVKDEPQRRSARLSAKPAPPKPEPKPRKSPVKKGEKVPKGKKGKADAGKEGNNPAENGDAKTDQAQKAEGAGDAK

SEQ ID NO: 10320 - protein, 524 aa, Human
QNKRENLLPVAAAGTANMMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 10321 - protein, 1044 aa, Human
RCLKLSNCHRAKFFFGKLNRTSTEYKMKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 10322 - protein, 343 aa, Human
ATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRSLLEKELESVGIRLNKHKPNIYFKPKKGGGISFNSTVTLTQCSEKLVQLILHEYKIFNAEVLFREDCSPDEFIDVIVGNRVYMPCLYVYNKIDQISMEEVDRLARKPNSVVISCGMKLNLDYLLEMLWEYLALTCIYTKKRGQRPDFTDAIILRKGASVEHVCHRIHRSLASQFKYALVWGTSTKYSPQRVGLTHTMEHEDVIQIVKK

SEQ ID NO: 10323 - protein, 358 aa, Human
GFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRVSEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 10324 - protein, 894 aa, Human
GSRARPGIPSSESVGYLGPSRWTSQSPGRLTSARVYGMEAGPSGAAAGAYLPPLQQVFQAPRRPGIGTVGKPIKLLANYFEVDIPKIDVYHYEVDIKPDKCPRRVNREVVEYMVQHFKPQIFGDRKPVYDGKKNIYTVTALPIGNERVDFEVTIPGEGKDRIFKVSIKWLAIVSWRMLHEALVSGQIPVPLESVQALDVAMRHLASMRYTPVGRSFFSPPEGYYHPLGGGREVWFGFHQSVRPAMWKMMLNIDVSATAFYKAQPVIEFMCEVLDIRNIDEQPKPLTDSQRVRFTKEIKGLKVEVTHCGQMKRKYRVCNVTRRPASHQTFPLQLESGQTVECTVAQYFKQKYNLQLKYPHLPCLQVGQEQKHTYLPLEVCNIVAGQRCIKKLTDNQTSTMIKATARSAPDRQEEISRLMKNASYNLDPYIQEFGIKVKDDMTEVTGRVLPAPILQYGGRNRAIATPNQGVWDMRGKQFYNGIEIKVWAIACFAPQKQCREEVLKNFTDQLRKISKDAGMPIQGQPCFCKYAQGADSVEPMFRHLKNTYSGLQLIIVILPGKTPVYAEVKRVGDTLLGMATQCVQVKNVVKTSPQTLSNLCLKINVKLGGINNILVPHQRSAVFQQPVIFLGADVTHPPAGDGKKPSITAVVGSMDAHPSRYCATVRVQRPRQEIIEDLSYMVRELLIQFYKSTRFKPTRIIFYRDGVPEGQLPQILHYELLAIRDACIKLEKDYQPGITYIVVQKRHHTRLFCADKNERIGKSGNIPAGTTVDTNITHPFEFDFYLCSHAGIQGTSRPSHYYVLWDDNRFTADELQILTYQLCHTYVRCTRSVSIPAPAYYARLVAFRARYHLVDKEHDSGEGSHISGQSNGRDPQALAKAVQVHQDTLRTMYFA

SEQ ID NO: 10325 - protein, 109 aa, Human
LVLCRTCSPWPSATMEYLIGIQGPDYVLVASDRVAASNIVQMKDDHDKMFKMSEKILLLCVGEAGDTVQFAEYIQKNVQLYKMRNGYELSPTAAANFTRRNLADCLRSR

SEQ ID NO: 10326 - protein, 1089 aa, Human
KSTRQKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQKIPEKDSDWLTWSGAPIPGFFRLSFDPHG

SEQ ID NO: 10327 - protein, 505 aa, Human
PTVASHADHAPNCHLLCRTAPKSYHPISDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLEDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFHLRKDLLHSLMGRLWNMVRRVRIGPSC

SEQ ID NO: 10328 - protein, 309 aa, Human
TRSISFTGSTKQCTTMNSELDYYEKFEEVHGILMYKDFVKYWDNVEAFQARPDDLVIATYPKSGTTWVSEIVYMIYKEGDVEKCKEDVIFNRIPFLECRKENLMNGVKQLDEMNSPRIVKTHLPPELLPASFWEKDCKIIYLCRNAKDVAVSFYYFFLMVAGHPNPGSFPEFVEKFMQGQVPYGSWYKHVKSWWEKGKSPRVLFLFYEDLKEDIRKEVIKLIHFLERKPSEELVDRIIHHTSFQEMKNNPSTNYTTLPDEIMNQKLSPFMRKGITGDWKNHFTVALNEKFDKHYEQQMKESTLKFRTEI

SEQ ID NO: 10329 - protein, 208 aa, Human
GSLLSPDMANKGPSYGMSREVQSKIEKKYDEELEERLVEWIIVQCGPDVGRPDRGRLGFQVWLKNGVILSKLVNSLYPDGSKPVKVPENPPSMVFKQMEQVAQFLKAAEDYGVIKTDMFQTVDLFEGKDMAAVQRTLMALGSLAVTKNDGHYRGDPNWFMKKAQEHKREFTESQLQEGKHVIGLQMGSNRGASQAGMTGYGRPRQIIS

SEQ ID NO: 10330 - protein, 523 aa, Human
TKTTLFLERPLFKKESITPTVELNALCMKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 10331 - protein, 523 aa, Human; identical to SEQ ID NO: 10330

SEQ ID NO: 10332 - protein, 523 aa, Human; identical to SEQ ID NO: 10330

SEQ ID NO: 10333 - protein, 523 aa, Human; identical to SEQ ID NO: 10330

SEQ ID NO: 10334 - protein, 1785 aa, Human
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITEMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 10335 - protein, 993 aa, Human
CQLRSAAGVPSSVSVSPRDPIAMELSDANLQTLTEYLKKTLDPDPAIRRPAEKFLESVEGNQNYPLLLLTLLEKSQDNVIKVCASVTFKNYIKRNWRIVEDEPNKICEADRVAIKANIVHLMLSSPEQIQKQLSDAISIIGREDFPQKWPDLLTEMVNRFQSGDFHVINGVLRTAHSLFKRYRHEFKSNELWTEIKLVLDAFALPLTNLFKATIELCSTHANDASALRILFSSLILISKLFYSLNFQDLPEFFEDNMETWMNNFHTLLTLDNKLLQTDDEEEAGLLELLKSQICDNAALYAQKYDEEFQRYLPRFVTAIWNLLVTTGQEVKYDLLVSNAIQFLASVCERPHYKNLFEDQNTLTSICEKVIVPNMEFRAADEEAFEDNSEEYIRRDLEGSDIDTRRRAACDLVRGLCKFFEGPVTGIFSGYVNSMLQEYAKNPSVNWKHKDAAIYLVTSLASKAQTQKHGITQANELVNLTEFFVNHILPDLKSANVNEFPVLKADGIKYIMIFRNQVPKEHLLVSIPLLINHLQAESIVVHTYAAHALERLFTMRGPNNATLFTAAEIAPFVEILLTNLFKALTLPGSSENEYIMKAIMRSFSLLQEAIIPYIPTLITQLTQKLLAVSKNPSKPHFNHYMFEAICLSIRITCKANPAAVVNFEEALFLVFTEILQNDVQEFIPYVFQVMSLLLETHKNDIPSSYMALFPHLLQPVLWERTGNIPALVRLLQAFLERGSNTIASAAADKIPGLLGVFQKLIASKANDHQGFYLLNSIIEHMPPESVDQYRKQIFILLFQRLQNSKTTKFIKSFLVFINLYCIKYGALALQEIFDGIQPKMFGMVLEKIIIPEIQKVSGNVEKKICAVGITKLLTECPPMMDTEYTKLWTPLLQSLIGLFELPEDDTIPDEEHFIDIEDTPGYQTAFSQLAFAGKKEHDPVGQMVNNPKIHLAQSLHKLSTACPGRVPSMVSTSLNAEALQYLQGYLQAASVTLL

SEQ ID NO: 10336 - protein, 163 aa, Human
VMRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 10337 - protein, 633 aa, Human
GARSSAGRAPAAAELAGAKRLHLAGDGARCGRPGIAWARLRGPGAHARTSPQPWRGPSPAQAAMGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 10338 - protein, 617 aa, Human
ITTLSTFNFLENACNSAEAMPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 10339 - protein, 206 aa, Human
APSPVRGAMAPARLFALLLFFVGGVAESIRETEVIDPQDLLEGRYFSGALPDDEDVVGPGQESDDFELSGSGDLDDLEDSMIGPEVVHPLVPLDNHIPERAGSGSQVPTEPKKLEENEVIPKRISPVEESEDVSNKVSMSSTVQGSNIFERTEVLAALIVGGIVGILFAVFLILLLMYRMKKKDEGSYDLGKKPIYKKAPTNEFYA

SEQ ID NO: 10340 - protein, 584 aa, Human
PSAMRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 10341 - protein, 584 aa, Human; identical to SEQ ID NO: 10340

SEQ ID NO: 10342 - protein, 191 aa, Human
SPSSCLSANAARMASQNRDPAATSVAAARKGAEPSGGAARGPVGKRLQQELMTLMMSGDKGISAFPESDNLFKWVGTIHGAAGTVYEDLRYKLSLEFPSGYPYNAPTVKFLTPCYHPNVDTQGNICLDILKEKWSALYDVRTILLSIQSLLGEPNIDSPLNTHAAELWKNPTAFKKYLQETYSKQVTSQEP

SEQ ID NO: 10343 - protein, 181 aa, Human
SLGGGVQRRRPATEESRSPATMTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNADGYIDPEELAEIFRASGEHVTDEEIESLMKDGDKNNDGRIDFDEFLKMMEGVQ

SEQ ID NO: 10344 - protein, 247 aa, Human
GMTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 10345 - protein, 410 aa, Human
EGSRKAAAAALAAVAAAPGPVRRCSSQSCFSSSGSSHYSARTSPVRVRPRRSLSSRSAAGNRAEATESAMEREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 10346 - protein, 410 aa, Human; identical to SEQ ID NO: 10345

SEQ ID NO: 10347 - protein, 664 aa, Human
ADGRMDVLVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVIVDFSSPNIAKEMHVGHLRSTIIGESISRLFEFAGYDVLRLNHVGDWGTQFGMLIAHLQDKFPDYLTVSPPIGDLQVFYKESKKRFDTEEEFKKRAYQCVVLLQGKNPDITKAWKLICDVSRQELNKIYDALDVSLIERGESFYQDRMNDIVKEFEDRGFVQVDDGRKIVFVPGCSIPLTIVKSDGGYTYDTSDLAAIKQRLFEEKADMIIYVVDNGQSVHFQTIFAAAQMIGWYDPKVTRVFHAGFGVVLGEDKKKFKTRSGETVRLMDLLGEGLKRSMDKLKEKERDKVLTAEELNAAQTSVAYGCIKYADLSHNRLNDYIFSFDKMLDDRGNTAAYLLYAFTRIRSIARLANIDEEMLQKAARETKILLDHEKEWKLGRCILRFPEILQKILDDLFLHTLCDYIYELATAFTEFYDSCYCVEKDRQTGKILKVNMWRMLLCEAVAAVMAKGFDILGIKPVQRM

SEQ ID NO: 10348 - protein, 1255 aa, Human
RSSTMRRGGWRKRAENDGWETWGGYMAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 10349 - protein, 154 aa, Human
EKKIEAMFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVRRQATTIIADNIIFLSDQTKEKE

SEQ ID NO: 10350 - protein, 138 aa, Human
RGCGVCCYSPSFAMPPKDDKKKKDAGKSAKKDKDPVNKSGGKAKKKKWSKGKVRDKLNNLVLFDKATYDKLCKEVPNYKLITPAVVSERLKIRGSLARAALQELLSKGLIKLVSKHRAQVIYTRNTKGGDAPAAGEDA

SEQ ID NO: 10351 - protein, 195 aa, Human
MADFDDRVSDEEKVRIAAKFITHAPPGEFNEVFNDVRLLLNNDNLLREGAAHAFAQYNMDQFTPVKIEGYEDQVLITEHGDLGNSRFLDPRNKISFKFDHLRKEASDPQPEEADGGLKSWRESCDSALRAYVKDHYSNGFCTVYAKTIDGQQTIIACIESHQFQPKNFWNGRWRSEWKFTITPPTAQVVGVLKIQ

SEQ ID NO: 10352 - protein, 723 aa, Human
RSCSRTSVDTSPGGKCPWAYLSNRQRRFSILGGPILGTSVASHLAELLHEELVLRWEQLLLDEACTGGALAWVPGRTPQFGQLVYPAGGAQDRLHFQEVVLTPGDNPQFLGKPGRIQLQGPVRQVVTCTVQGESKALIYTFLPHWLTCYLTPGPFHPSSALLAVRSDYHCAVWKFGKQWQPTLLQAMQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPMPSAPTPGLVLFQLSAAGDVFYQQLRPQVDSSLRRDAGPPGDTQPDCHAPTASWTSQDTAGCSQWLKALLKVPLAPPVWTAPTFTHRQMLGSTELRREEEEGQRLGVLRKAMARGQLLLQRDLGSLPAAEPPPAPESGLEDKLSERLGEAWAGRGAAWWERQQGRTSEPGRQTRRPKRRTQLSSSFSLSGHVDPSEDTSSPHSPEWPPADALPLPPTTPPSQELTPDACAQGVPSEQRQMLRDYMAKLPPQRDTPGCATTPPHSQASSVRATRSQQHTPVLSSSQPLRKKPRMGF

SEQ ID NO: 10353 - protein, 170 aa, Human
AGVRRWAEATMAAERKTKLSKNLLRMKFMQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYETLVGTIGKKFARKRDHANYEEDENGDITPIKAKKMFLKPQD

SEQ ID NO: 10354 - protein, 549 aa, Human
YQSPAWQSHWHQKLQENMAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 10355 - protein, 593 aa, Human
WPGNSSILIGGGHLFLIRSCLNLLLLNSKENTEHTMAKKVAVIGAGVSGLSSIKCCVDEDLEPTCFERSDDIGGLWKFTESSKDGMTRVYKSLVTNVCKEMSCYSDFPFHEDYPNFMNHEKFWDYLQEFAEHFDLLKYIQFKTTVCSITKRPDFSETGQWDVVTETEGKQNRAVFDAVMVCTGHFLNPHLPLEAFPGIHKFKGQILHSQEYKIPEGFQGKRVLVIGLGNTGGDIAVELSRTAAQVLLSTRTGTWVLGRSSDWGYPYNMMVTRRCCSFIAQVLPSRFLNWIQERKLNKRFNHEDYGLSITKGKKAKFIVNDELPNCILCGAITMKTSVIEFTETSAVFEDGTVEENIDVVIFTTGYTFSFPFFEEPLKSLCTKKIFLYKQVFPLNLERATLAIIGLIGLKGSILSGTELQARWVTRVFKGLCKIPPSQKLMMEATEKEQLIKRGVFKDTSKDKFDYIAYMDDIAACIGTKPSIPLLFLKDPRLAWEVFFGPCTPYQYRLMGPGKWDGARNAILTQWDRTLKPLKTRIVPDSSKPASMSHYLKAWGAPVLLASLLLICKSSLFLKLVRDKLQDRMSPYLVSLWRG

SEQ ID NO: 10356 - protein, 347 aa, Human
YCILVWIISLDRAGLGLRKATKAAEGGWCRTLCSTEGGPPPSFPIFFFWPSSPSLPLPPSLSLSLHYPPLSSPLGSSPPSRPQRLVLIRAGRGGWVGSVGETMTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYSAMATYSATCANNSPAQGINMANSIANLRLKAKEYSLQRNQVPTVN

SEQ ID NO: 10357 - protein, 347 aa, Human; identical to SEQ ID NO: 10356

SEQ ID NO: 10358 - protein, 327 aa, Human
FPIPGPGPALGSYCPLLLGPVPQMGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 10359 - protein, 447 aa, Human
EAQPPSPVSITSAASMSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 10360 - protein, 404 aa, Human
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARNNVSLLQSCIDLFKNN

SEQ ID NO: 10361 - protein, 173 aa, Human [sequence omitted]

SEQ ID NO: 10362 - protein, 593 aa, Human
FVGDHKPTLSWEVRALLDRRWKKTWPKEVSFGGPFQSLHLSPALQRGALLAFALQRRGGIVGEQNLARAQGPGRTMADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 10363 - protein, 329 aa, Human
AEHSIVGTRLVSGQLQPSQPNADQGKLTTMRIAVICFCLLGITCAIPVKQADSGSSEEKQLYNKYPDAVATWLNPDPSQKQNLLAPQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 10364 - protein, 534 aa, Human
FLRLFEKILCELRRVEVSHPTMKISILLMFLWGLSCALPVTRYQNNESEDSEEWKGHLAQAPTPPLESSESSEGSKVSSEEQANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 10365 - protein, 342 aa, Human
QSVPLTALSLLPHSRTARGPEAITKMKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGEDNGEEGEEESVTGANAEGTTETGRQGKGTSKTTTSPNGGFEPTTPPQVYRTTSPPFGKTTTVEYEGEYEYTGANDYDNGYEIYESENGEPRGDNYRAYEDEYSYFKGQGYDGYDGQNYYHHQ

SEQ ID NO: 10366 - protein, 1259 aa, Human
LLLFLKKMKIITYFCIWAVAWAIPVPQSKPLERHVEKSMNLHLLARSNVSVQDELNASGTIKESGVLVHEGDRGRQENTQDGHKGEGNGSKWAEVGGKSFSTYSTLANEEGNIEGWNGDTGKAETYGHDGIHGKEENITANGIQGQVSIIDNAGATNRSNTNGNTDKNTQNGDVGDAGHNEDVAVVQEDGPQVAGSNNSTDNEDEIIENSCRNEGNTSEITPQINSKRNGTKEAEVTPGTGEDAGLDNSDGSPSGNGADEDEDEGSGDDEDEEAGNGKDSSNNSKGQEGQDHGKEDDHDSSIGQNSDSKEYYDPEGKEDPHNEVDGDKTSKSEENSAGIPEDNGSQRIEDTQKLNHRESKRVENRITKESETHAVGKSQDKGIEIKGPSSGNRNITKEVGKGNEGKEDKGQHGMILGKGNVKTQGEVVNIEGPGQKSEPGNKVGHSNTGSDSNSDGYDSYDFDDKSMQGDDPNSSDESNGNDDANSESDNNSSSRGDASYNSDESKDNGNGSDSKGAEDDDSDSTSDTNNSDSNGNGNNGNDDNDKSDSGKGKSDSSDSDSSDSSNSSDSSDSSDSDSSDSNSSSDSDSSDSDSSDSSDSDSSDSSNSSDSSDSSDSSDSSDSSDSSDSKSDSSKSESDSSDSDSKSDSSDSNSSDSSDNSDSSDSSNSSNSSDSSDSSDSSDSSSSSDSSSSSDSSNSSDSSDSSDSSNSSESSDSSDSSDSDSSDSSDSSNSNSSDSDSSNSSDSSDSSDSSDSSNSSDSSDSSDSSNSSDSSDSSDSSDSSDSSNSSDSNDSSNSSDSSDSSNSSDSSNSSDSSDSSDSSDSDSSNSSDSSNSSDSSDSNSSDSSDSSDSSDSSDSDSSNRSDSSNSSDSSDSSDSSNSSDSSDSSDSSDSNESSNSSDSSDSSNSSDSDSSDSSNSSDSSDSSNSSDSSESSNSSDNSNSSDSSNSSDSSDSSDSSNSSDSSNSGDSSNSSDSSDSNSSDSSDSSNSSDSSDSSDSSDSSDSSDSSNSSDSSDSSDSSDSSNSSDSSNSSDSSDSSDSSDSSDSSDSSNSSDSSDSSDSSDSSDSSGSSDSSDSSDSSDSSDSSDSSDSSDSSDSSESSDSSDSSDSSDSSDSSDSSDSSDSSDSSDSSDSSNSSDSSDSSDSSDSSDSSDSSDSSDSSDSSDSSDSSDSSDSSDSSDSSDSSDSNESSDSSDSSDSSDSSNSSDSSDSSDSSDSTSDSNDESDSQSKSGNGNNNGSDSDSDSEGSDSNHSTSDD

SEQ ID NO: 10367 - protein, 709 aa, Human
RGKGFKEFFLGVCQTFIPCLCAEGIQLQFFCSGSGSSPLLKDLESMKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 10368 - protein, 987 aa, Human
GAQRRARRRAPARRTPVTAMVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 10369 - protein, 769 aa, Human
LMEASVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 10370 - protein, 157 aa, Human
QDLQTHHMKARRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 10371 - protein, 507 aa, Human
ERSLRLLLGSGTIMFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLNLQVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 10372 - protein, 379 aa, Human
SWKRLGAPQPPPTQMGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPVGAEAWARRVPQPAAPPRRPPQSASSLSASLRPPGAPATFLRPSPIPCSSPGPWQSLCGLGPPCAGCPWPTAGPGRRSPGGTSPERSPGTARARGDPTSLQASSEKTQQ

SEQ ID NO: 10373 - protein, 285 aa, Human
LGPPSFERTGLSARGDRGGSWGAFPMELTQPAEDLIQTQQTPASELGDPEDPGEEAADGSDTVVLSLFPCTPEPVNPEPDASVSSPQAGSSLKHSTTLTNRQRGNEVSALPATLDSLSIHQLAAQGELDQLKEHLRKGDNLVNKPDERGFTPLIWASAFGEIETVRFLLEWGADPHILAKERESALSLASTGGYTDIVGLLLERDVDINIYDWNGGTPLLYAVRGNHVKCVEALLARGADLTTEADSGYTPMDLAVALGYRKVQQVIENHILKLFQSNLVPADPE

SEQ ID NO: 10374 - protein, 648 aa, Human
LPGRWEMDSVSFEDVAVNFTLEEWALLDSSQKKLYEDVMQETFKNLVCLGKKWEDQDIEDDHRNQGKNRRCHMVERLCESRRGSKCGETTSQMPNVNINKETFTGAKPHECSFCGRDFIHHSSLNRHMRSHTGQKPNEYQEYEKQPCKCKAVGKTFSYHHCFRKHERTHTGVKPYECKQCGKAFIYYQPFQRHERTHAGQKPYECKQCGKTFIYYQSFQKHAHTGKKPYECKQCGKAFICYQSFQRHKRTHTGEKPYECKQCGKAFSCPTYFRTHERTHTGEKPYKCKECGKAFSFLSSFRRHKRTHSGEKPYECKECGKAFFYSASFRAHVIIHTGARPYKCKECGKAFNSSNSCRVHERTHIGEKPYECKRCGKSFSWSISLRLHERTHTGEKPYECKQCHKTFSFSSSLREHETTHTGEKPYECKQCGKTFSFSSSLQRHERTHNAEKPYECKQCGKAFRCSSYFRIHERSHTGEKPYECKQCGKVFIRSSSFRLHERTHTGEKPYECKLCGKTFSFSSSLREHEKIHTGNKPFECKQCGKAFLRSSQIRLHERTHTGEKPYQCKQCGKAFISSSKFRMHERTHTGEKPYRCKQCGKAFRFSSSVRIHERSHTGEKPYECKQCGKAFISSSHFRLHERTHMGEKV

SEQ ID NO: 10375 - protein, 606 aa, Human
DNLSDTLKKLKITAVDKTEDSLEGCLDCLLQALAQNNTETSEKIQASGILQLFASLLTPQSSCKAKVANIIAEVAKNEFMRIPCVDAGLISPLVQLLNSKDQEVLLQTGRALGNICYDSHEGRSAVDQAGGAQIVIDHLRSLCSITDPANEKLLTVFCGMLMNYSNENDSLQAQLINMGVIPTLVKLLGIHCQNAALTEMCLVAFGNLAELESSKEQFASTNIAEELVKLFKKQIEHDKREMIFEVLAPLAENDAIKLQLVEAGLVECLLEIVQQKVDSDKEDDITELKTGSDLMVLLLLGDESMQKLFEGGKGSVFQRVLSWIPSNNHQLQLAGALAIANFARNDANCIHMVDNGIVEKLMDLLDRHVEDGNVTVQHAALSALRNLAIPVINKAKMLSAGVTEAVLKFLKSEMPPVQFKLLGTLRMLIDAQAEAAEQLGKNVKLVERLVEWCEAKDHAGVMGESNRLLSALIRHSKSKDVIKTIVQSGGIKHLVTMATSEHVIMQNEALVALALIAALELGTAEKDLESAKLVQILHRLLADERSAPEIKYNSMVLICALMGSECLHKEVQDLAFLDVVSKLRSHENKSVAQQASLTEQRLTVES

SEQ ID NO: 10376 - protein, 263 aa, Human
RTEACSGQQMDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 10377 - protein, 263 aa, Human; identical to SEQ ID NO: 10376

SEQ ID NO: 10378 - protein, 636 aa, Human
RYHLMETPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 10379 - protein, 565 aa, Human
TMSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 10380 - protein, 251 aa, Human
EPGLTTKGEMSNPRSLEEEKYDMSGARLALILCVTKAREGSEEDLDALEHMFRQLRFESTMKRDPTAEQFQEELEKFQQAIDSREDPVSCAFVVLMAHGREGFLKGEDGEMVKLENLFEALNNKNCQALRAKPKVYIIQACRGEQRDPGETVGGDEIVMVIKDSPQTIPTYTDALHVYSTVEGYIAYRHDQKGSCFIQTLVDVFTKRKGHILELLTEVTRRMAEAELVQEGKARKTNPEIQSTLRKRLYLQ

SEQ ID NO: 10381 - protein, 846 aa, Human
RRRDSPVPLTLSPAAPAGSSAGTMGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATFTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 10382 - protein, 763 aa, Human
RPGPGRSMAEPLLRKTFSRLRGREKLPRKKSDAKERGHPAQRPEPSPPEPEPQAPEGSQAGAEGPSSPEASRSPARGAYLQSLEPSSRRWVLGGAKPAEDTSLGPGVPGTGEPAGEIWYNPIPEEDPRPPAPEPPGPQPGSAESEGLAPQGAAPASPPTKASRTKSPGPARRLSIKMKKLPELRRRLSLRGPRAGRERERAAPAGSVISRYHLDSSVGGPGPAAGPGGTRSPRAGYLSDGDSPERPAGPPSPTSFRPYEVGPAARAPPAALWGRLSLHLYGLGGLRPAPGATPRDLCCLLQVDGEARARTGPLRGGPDFLRLDHTFHLELEAARLLRALVLAWDPGVRRHRPCAQGTVLLPTVFRGCQAQQLAVRLEPQGLLYAKLTLSEQQEAPATAEPRVFGLPLPLLVERERPPGQVPLIIQKCVGQIERRGLRVVGLYRLCGSAAVKKELRDAFERDSAAVCLSEDLYPDINVITAVPSLALEASGALTRGDPVFTGILKDYLRELPTPLITQPLYKVVLEAMARDPPNRVPPTTEGTRGLLSCLPDVERATLTLLLDHLRLVSSFHAYNRMTPQNLAVCFGPVLLPARQAPTRPRARSSGPGLASAVDFKHHIEVLHYLLQSWPDPRLPRQSPDVAPYLRPKRQPPLHLPLADPEVVTRPRGRGGPESPPSNRYAGDWSVCGRDFLPCGRDFLSGPDYDHVTGSDSEDEDEEVGEPRVTGDFEDDFDAPFNPHLNLKDFDALILDLERELSKQINVCL

SEQ ID NO: 10383 - protein, 311 aa, Human
GAQAPPSRQPRGPSGPGTRSRARAGGRSRRLTMHCHAELRLSSPGQLKAARRRYKTFMIDEILSKETCDYFEKLSLYSVCPSLVVRPKPLHSCTGSPSLRAYPLLSVITRQPTVISHLVPATPGIAQALSCHQVTEAVSAEAPGGEALASSESETEQPTPRQKKPRRSRTIFTELQLMGLEKKFQKQKYLSTPDRLDLAQSLGLTQLQVKTWYQNRRMKWKKMVLKGGQEAPTKPKGRPKKNSIPTSEEIEAEEKMNSQAQGQEQLEPSQGQEELCEAQEPKARDVPLEMAEPPDPPQELPIPSSEPPPLS

SEQ ID NO: 10384 - protein, 356 aa, Human
RTCPTMGMTAWACTPSSTWCASCTPGPTSGCRHCPLCSWRRSTSRSSPRRRTRSGRTPARTNVTKTSGPRRRRVTASQSSSSSAPRKQAGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQHQRAHDDPVALKYTFHEVITAGSDASSKLRALQNRCLVPGWYATHIERWLSAYHANQILVLDGKLLRTEPAKVMDMVQKFLGVTNTIDYHKTLAFDPKKGFWCQLLEGGKTKCLGKSKGRKYPEMDLDSRAFLKDYYRDHNIELSKLLYKMGQTLPTWLREDLQNTR

SEQ ID NO: 10385 - protein, 290 aa, Human
AVARRRGGRQRRLQGPACAGDPAATMYVGYVLDKDSPVYPGPARPASLGLGPQAYGPPAPPPAPPQYPDFSSYSHVEPAPAPPTAWGAPFPAPKDDWAAAYGPGPAAPAASPASLAFGPPPDFSPVPAPPGPGPGLLAQPLGGPGTPSSPGAQRPTPYEWMRRSVAAGGGGGSGKTRTKDKYRVVYTDHQRLELEKEFHYSRYITIRRKSELAANLGLTERQVKIWFQNRRAKERKVNKKKQQQQQPPQPPMAHDITATPAGPSLGGLCPSNTSLLATSSPMPVKEEFLP

SEQ ID NO: 10386 - protein, 632 aa, Human
SRSSPGQPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALLVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 10387 - protein, 748 aa, Human
RKLNHLSPEMSSESKEQHNVSPRDSAEGNDSYPSGIHLELQRESSTDFKQFETNDQCRPYHRILIERQEKSDTNFKEFVIKKLQKNCQCSPAKAKNMILGFLPVLQWLPKYDLKKNILGDVMSGLIVGILLVPQSIAYSLLAGQEPVYGLYTSFFASIIYFLLGTSRHISVGIFGVLCLMIGETVDRELQKAGYDNAHSAPSLGMVSNGSTLLNHTSDRICDKSCYAIMVGSTVTFIAGVYQVAMGFFQVGFVSVYLSDALLSGFVTGASFTILTSQAKYLLGLNLPRTNGVGSLITTWIHVFRNIHKTNLCDLITSLLCLLVLLPTKELNEHFKSKLKAPIPIELVVVVAATLASHFGKLHENYNSSIAGHIPTGFMPPKVPEWNLIPSVAVDAIAISIIGFAITVSLSEMFAKKHGYTVKANQEMYAIGFCNIIPSFFHCFTTSAALAKTLVKESTGCHTQLSGVVTALVLLLVLLVIAPLFYSLQKSVLGVITIVNLRGALRKFRDLPKMWSISRMDTVIWFVTMLSSALLSTEIGLLVGVCFSIFCVILRTQKPKSSLLGLVEESEVFESVSAYKNLQTKPGIKIFRFVAPLYYINKECFKSALYKQTVNPILIKVAWKKAAKRKIKEKVVTLGGIQDEMSVQLSHDPLELHTIVIDCSAIQFLDTAGIHTLKEVRRDYEAIGIQVLLAQCNPTVRDSLTNGEYCKKEEENLLFYSVYEAMAFAEVSKNQKGVCVPNGLSLSSD

SEQ ID NO: 10388 - protein, 151 aa, Human [sequence omitted]

SEQ ID NO: 10389 - protein, 234 aa, Human
SQMHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 10390 - protein, 144 aa, Human
ISSCLEADSTEIMAFDSTWKVDRSENYDKFMEKMGVNIVKRKLAAHDNLKLTITQEGNKFTVKESSAFRNIEVVFELGVTFNYNLADGTELRGTWSLEGNKLIGKFKRTDNGNELNTVREIIGDELVQTYVYEGVEAKRIFKKD

SEQ ID NO: 10391 - protein, 728 aa, Human
GLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 10392 - protein, 354 aa, Human
GPEMSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKGEHGVKEVLNILTNEFHTSMALTGCRSVAEINRNLVQFSRL

SEQ ID NO: 10393 - protein, 1135 aa, Human
SSPRRLRSSPSSPAAGPGEDATAARVTMGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGSRQVQFHQGFGDLAVLKPSNKVLQVSIGPGLPKNSRPTRRNTTQNTGYSSGTQNANYPVRAAPPPPGYHQNGVIRNQYVPYPHAPGSQRSNQKSLYTSMARPPLPRQQSTSSDRVSQTPESLDFLKVPDQGAAGVRRQTTSRPPPAGGRPKPQPKPKPQVPQCKALYAYDAQDTDELSFNANDIIDIIKEDPSGWWTGRLRGKQGLFPNNYVTKI

SEQ ID NO: 10394 - protein, 546 aa, Human
QYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 10395 - protein, 142 aa, Human
RASVAAMVLLESEQFLTELTRLFQKCRTSGSVYITLKKYDGRTKPIPKKGTVEGFEPADNKCLLRATDGKKKISTVVSSKEVNKFQMAYSNLLRANMDGLKKRDKKNKTKKTKAAAAAAAAAPAAAATAATTAATTAATAAQ

SEQ ID NO: 10396 - protein, 494 aa, Human
MWAPRKRMVRVQPPPPVQRSCVVNATTIVQKTQSTIFAGCTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 10397 - protein, 1441 aa, Human
LAERRRGGAERACGPCAADFSTGSWAPKDKPLIMKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 10398 - protein, 1236 aa, Human
ATLLQTTEMKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNLTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 10399 - protein, 158 aa, Human
MDNLSSEEIQQRAHQITDESLESTRRILGLAIESQDAGIKTITMLDEQKEQLNRIEEGLDQINKDMRETEKTLTELNKCCGLCVCPCNSITNDAREDEMEENLTQVGSILGNLKDMALNIGNEIDAQNPQIKRITDKADTNRDRIDIANARAKKLIDS

SEQ ID NO: 10400 - protein, 550 aa, Human
EGDSSLEPSLILVIPGSKSPPFPAQLSTSATSKIPTLIMLFPISMSATEFLLASVIFCLVFWVIRASRPQVPKGLKNPPGPWGWPLIGHMLTLGKNPHLALSRMSQQYGDVLQIRIGSTPVVVLSGLDTIRQALVRQGDDFKGRPDLYTFTLISNGQSMSFSPDSGPVWAARRRLAQNGLKSFSIASDPASSTSCYLEEHVSKEAEVLISTLQELMAGPGHFNPYRYVVVSVTNVICAICFGRRYDHNHQELLSLVNLNNNFGEVVGSGNPADFIPILRYLPNPSLNAFKDLNEKFYSFMQKMVKEHYKTFEKGHIRDITDSLIEHCQEKQLDENANVQLSDEKIINIVLDLFGAGFDTVTTAISWSLMYLVMNPRVQRKIQEELDTVIGRSRRPRLSDRSHLPYMEAFILETFRHSSFVPFTIPHSTTRDTSLKGFYIPKGRCVFVNQWQINHDQKLWVNPSEFLPERFLTPDGAIDKVLSEKVIIFGMGKRKCIGETIARWEVFLFLAILLQRVEFSVPLGVKVDMTPIYGLTMKHACCEHFQMQLRS

SEQ ID NO: 10401 - protein, 309 aa, Human
VKMGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILADDVPCHLVSALIAGFCATAMSSPVDVVKTRFINSPPGQYKSVPNCAMKVFTNEGPTAFFKGLVPSFLRLGSWNVIMFVCFEQLKRELSKSRQTMDCAT

SEQ ID NO: 10402 - protein, 193 aa, Human
RTEACSGQQMDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSGQSVVPEPKDEVEACEGRSAHLPQWAGP

SEQ ID NO: 10403 - protein, 1935 aa, Human
SPARGTGGGIAGPRRRGALQGAAAAADRAPGAARGGGSRWRLGIMRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSYRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTGDLLHSVEVKGQALSSTFIPVYPLILMSAGRSQGSVKMECVSTWLAASDVNVQWDSSIMTSCWFVKILTSVRTAQCASATPNASTLQAATAVTVSPATASPPQDSAMIVMNVKKSPIYAVMGSALTQLEAFIAFATLVLKQMMTKPCAWT

SEQ ID NO: 10404 - protein, 1120 aa, Human
FIMPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEYVVLLDWFSSAKDLQIGTTLRSLKDALFKWESKTVLRNEPLVLEGGYENWLLCYPQYTTNAKVTPPPRRQNEEVSISLDFTYPSLEESIPSKPAAQTPPASIEVDENIELISGQNERMGPLNISTPVEPVAASKSDVSPIIQPVPSIKNVPQIDRTKKPAVKLPEEHRIKSESTNHEQQSPQSGKVIPDRSTKPVVFSPTLMLTDEEKARIHAETALLMEKNKQEKELRERQQEEQKEKLRKEEQEQKAKKKQEAEENEITEKQQKAKEEMEKKESEQAKKEDKETSAKRGKEITGVKRQSKSEHETSDAKKSVEDRGKRCPTPEIQKKSTGDVPHTSVTGDSGSGKPFKIKGQPESGILRTGTFREDTDDTERNKAQREPLTRARSEEMGRIVPGLPSGWAKFLDPITGTFRYYHSPTNTVHMYPPEMAPSSAPPSTPPTHKAKPQIPAERDREPSKLKRSYSSPDITQAIQEEEKRKPTVTPTVNRENKPTCYPKAEISRLSASQIRNLNPVFGGSGPALTGLRNLGNTCYMNSILQCLCNAPHLADYFNRNCYQDDINRSNLLGHKGEVAEEFGIIMKALWTGQYRYISPKDFKITIGKINDQFAGYSQQDSQELLLFLMDGLHEDLNKADNRKRYKEENNDHLDDFKAAEHAWQKHKQLNESIIVALFQGQFKSTVQCLTCHKKSRTFEAFMYLSLPLASTSKCTLQDCLRLFSKEEKLTDNNRFYCSHCRARRDSLKKIEIWKLPPVLLVHLKRFSYDGRWKQKLQTSVDFPLENLDLSQYVIGPKNNLKKYNLFSVSNHYGGLDGGHYTAYCKNAARQRWFKFDDHEVSDISVSSVKSSAAYILFYTSLGPRVTDVAT

SEQ ID NO: 10405 - protein, 563 aa, Human
KATPWRAVSASQELQHPQGGQRSPLPGDLTPARPNPAYPLTVECQRSCSRPVPAPLPPHTHPPGSSCFYSSFSFITKATAPGAQRRAVTQAERGRMGFLGTGTWILVLVLPIQAFPKPGGSQDKSLHNRELSAERPLNEQIAEAEEDKIKKTYPPENKPGQSNYSFVDNLNLLKAITEKEKIEKERQSIRSSPLDNKLNVEDVDSTKNRKLIDDYDSTKSGLDHKFQDDPDGLHQLDGTPLTAEDIVHKIAARIYEENDRAVFDKIVSKLLNLGLITESQAHTLEDEVAEVLQKLISKEANNYEEDPNKPTSWTENQAGKIPEKVTPMAAIQDGLAKGENDETVSNTLTLTNGLERRTKTYSEDNFEELQYFPNFYALLKSIDSEKEAKEKETLITIMKTLIDFVKMMVKYGTISPEEGVSYLENLDEMIALQTKNKLEKNATDNISKLFPAPSEKSHEETDSTKEEAAKMEKEYGSLKDSTKDDNSNPGGKTDEPKGKTEAYLEAIRKNIEWLKKHDKKGNKEDYDLSKMRDFINKQADAYVEKGILDKEEAEAIKRIYSSL

SEQ ID NO: 10406 - protein, 127 aa, Human
ASGMADEEEDPTFEEENEEIGGGAEGGQGKRKRLFSKELRCMMYGFGDDQNPYTESVDILEDLVIEFITEMTHKAMSIGRQGRVQVEDIVFLIRKDPRKFARVKDLLTMNEELKRARKAFDEANYGS

SEQ ID NO: 10407 - protein, 892 aa, Human
RIPRSSGNVLTDQVEAQGEKIRDLEFCLEEHREKLNATEEMLQQELLSRTSLETQKLDLMAEISNLKLKLTAVEKDRLDYEDKFRDTEGLIQEINDLRLKVSEMDSERLQYEKKLKSTKDELASLKEQLEEKESEVKRLQEKLVCKMKGEGVEIVDRDENFKKKLKEKNIEVQKMKKAVESLMAANEEKDRKIEDLRQCLNRYKKMQDTVVLAQGKKGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLDRKRSASAPTLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 10408 - protein, 1116 aa, Human
LEGSLNTERAKYYLTITMPHFTVTKVEDPEEGAAASISQEPSLADIKARIQDSDEPDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 10409 - protein, 239 aa, Human
DLQCPCHVRGHPGSIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 10410 - protein, 307 aa, Human
TAWTAATRTVCTARAPPASSRPTLTPVPRRRRPMAETHAWAGTRLTPTRRPRRTVPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 10411 - protein, 141 aa, Human
GCVGVRPSLHPATSTASGSASPTLARAMASVSELACIYSALILHDDEVTVTEDKINALIKAAGVNVEPFWPGLFAKALANVNIGSLICNVGAGGPAPAAGAAPAGGPAPSTAAAPAEEKKVEAKKEESEESDDDMGFGLFD

SEQ ID NO: 10412 - protein, 287 aa, Human
ADTQCRRPSRRRQIGADSCPAPTASATMSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 10413 - protein, 760 aa, Human
IDTSQDLTGSEFIMSKLKSSESVRVVVRCRPMNGKEKAASYDKVVDVDVKLGQVSVKNPKGTAHEMPKTFTFDAVYDWNAKQFELYDETFRPLVDSVLQGFNGTIFAYGQTGTGKTYTMEGIRGDPEKRGVIPNSFDHIFTHISRSQNQQYLVRASYLEIYQEEIRDLLSKDQTKRLELKERPDTGVYVKDLSSFVTKSVKEIEHVMNVGNQNRSVGATNMNEHSSRSHAIFVITIECSEVGLDGENHIRVGKLNLVDLAGSERQAKTGAQGERLKEATKINLSLSALGNVISALVDGKSTHIPYRDSKLTRLLQDSLGGNAKTVMVANVGPASYNVEETLTTLRYANRAKNIKNKPRVNEDPKDALLREFQEEIARLKAQLEKRSIGRRKRREKRREGGGSGGGGEEEEEEGEEGEEEGDDKDDYWREQQEKLEIEKRAIVEDHSLVAEEKMRLLKEKEKKMEDLRREKDAAEMLGAKIKAMESKLLVGGKNIVDHTNEQQKILEQKRQEIAEQKRREREIQQQMESRDEETLELKETYSSLQQEVDIKTKKLKKLFSKLQAVKAEIHDLQEEHIKERQELEQTQNELTRELKLKHLIIENFIPLEEKSKIMNRAFFDEEEDHWKLHPITRLENQQMMKRPVSAVGYKRPLSQHARMSMMIRPEARYRAENIVLLELDMPSRTTRDYEGPAIAPKVQAALDAALQDEDEIQVDASSFESTANKKSKARPKSGRKSGSSSSSSGTPASQLYPQSRGLVPK

SEQ ID NO: 10414 - protein, 324 aa, Human
WPDRRHYRGLRGPGGARARPGPQRGAPSAVKRLFSESCVGGCDRAESLCGADGEAFSITWPFAISLAMTTFFTSVPPWIQDAKQEEEVGWKLVPRPRGREAESQVKCQCEISGTPFSNGEKLRPHSLPQPEQRPYSCPQLHCGKAFASKYKLYRHMATHSAQKPHQCMYCDKMFHRKDHLRNHLQTHDPNKEALHCSECGKNYNTKLGYRRHLAMHAASSGDLSCKVCLQTFESTQALLEHLKAHSRRVAGGAKEKKHPCDHCDRRFYTRKDVRRHLVVHTGRKDFLCQYCAQRFGRKDHLTRHVKKSHSQEQLKIKTEPVGTC

SEQ ID NO: 10415 - protein, 573 aa, Human
RVGRDSDSAGRETPAAPKPLRASPPPLVLESQFPGTGTPEPQGLPSWGGAQAARIRAARETRSGRPGEMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 10416 - protein, 186 aa, Human
AGVLDNGLVEPIPIIKMSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQDTFVELYGNNAAAESRKGQERFNRWFLTGMTVAGVVLLGSLFSRK

SEQ ID NO: 10417 - protein, 528 aa, Human
KCSKRWWRCGKRMKNSRNLLLAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 10418 - protein, 861 aa, Human
YSTVVLSLLLIRSMEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 10419 - protein, 441 aa, Human [sequence omitted]

SEQ ID NO: 10420 - protein, 227 aa, Human
TTEFFIMSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPYFETSAANGTNISQAIEMLLDLIMKRMERCVDKSWIPEGVVRSNGHASTDQLSEEKEKGACGC

SEQ ID NO: 10421 - protein, 456 aa, Human
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 10422 - protein, 691 aa, Human
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDSPLCHVDIAIPCNNKGAHSVGLMWMLAREVLRVRGTISREHPWEVMPELYFYRDPEVIKKEEQAATEKAVTKEEFQCEWTAPAPEFTATQPELINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKVKPAPLEIKPLPEWEELQAPVRSPITRSFAREFPMSPRPDSVHSTTSSSDSHDSEENYVPMNPNLSSEDPNLFGSNSLDGGSSPMIKPKGDKQVEYLDLDLDSGKSTPPRK

SEQ ID NO: 10423 - protein, 1008 aa, Human
DTAEVLGPDTRLPSLNGQRKTQTSFPVVPPTPVRHRRHSENREPLRKPKTLSSRPAKQQAHKPTPPSAPWRSRPLFSPEPARDLEEGGPRPAFLDLSDPSGPAHPRRRDSRRESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQRECQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQAQKEEQLKIDEAESLNDEELEEKEKLLTQGFTNWNKRDFNQFIKANEKWGRDDIENIAREVEGKTPEEVIEYSAVFWERCNELQDIEKIMAQIERGEARIQRRISIKKALDTKIGRYKAPFHQLRISYGTNKGKNYTEEEDRFLICMLHKLGFDKENVYDELRQCIRNSPQFRFDWFLKSRTAMELQRRCNTLITLIERENMELEEKEKAEKKKRGPKPSTQKRKMDGAPDGRGRKKKLKL

SEQ ID NO: 10424 - protein, 502 aa, Human
NGEMDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDASFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 10425 - protein, 297 aa, Human
APPPAPARSMAAAAYVDHFAAECLVSMSSRAVVHGPREGPESRPEGAAVAATPTLPRVEERRDGKDSASLFVVARILADLNQQAPAPAPAERREGAAARKARTPCRLPPPAPEPTSPGAEGAAAAPPSPAWSEPEPEAGLEPEREPGPAGSGEPGLRQRVRRGRSRADLESPQRKHKCHYAGCEKVYGKSSHLKAHLRTHTGERPFACSWQDCNKKFARSDELARHYRTHTGEKKFSCPICEKRFMRSDHLTKHARRHANFHPGMLQRRGGGSRTGSLSDYSRSDASSPTISPASSP

SEQ ID NO: 10426 - protein, 637 aa, Human
FQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 10427 - protein, 345 aa, Human
FGGEEMADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 10428 - protein, 267 aa, Human
IQMNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 10429 - protein, 267 aa, Human; identical to SEQ ID NO: 10428

SEQ ID NO: 10430 - protein, 267 aa, Human; identical to SEQ ID NO: 10428

SEQ ID NO: 10431 - protein, 267 aa, Human; identical to SEQ ID NO: 10428

SEQ ID NO: 10432 - protein, 267 aa, Human; identical to SEQ ID NO: 10428

SEQ ID NO: 10433 - protein, 267 aa, Human; identical to SEQ ID NO: 10428

SEQ ID NO: 10434 - protein, 267 aa, Human; identical to SEQ ID NO: 10428

SEQ ID NO: 10435 - protein, 487 aa, Human
WAKDSPVLGGVMAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKVWLPAT

SEQ ID NO: 10436 - protein, 721 aa, Human
ESRPADRRVLPPIHVKMTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKVKDLDNRGLSRT

SEQ ID NO: 10437 - protein, 394 aa, Human
ARMEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEIHEKEEEEFNEKSENDSGINEEPLLTADQVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 10438 - protein, 162 aa, Human
VSALRAQSVPAAPPLSVPAAAATATMPNFAGTWKMRSSENFDELLKALGVNAMLRKVAVAAASKPHVEIRQDGDQFYIKTSTTVRTTEINFKVGEGFEEETVDGRKCRSLATWENENKIHCTQTLLEGDGPKTYWTRELANDELILTFGADDVVCTRIYVRE

SEQ ID NO: 10439 - protein, 158 aa, Human
LHSRFYELAPNLVPMDYRKSPIVHVPMSLIIQMPELRENPFKERIVAAFSEDGEGNLTFNDFVDMFSVLCESAPRELKANYAFKIYDFNTDNFICKEDLELTLARLTKSELDEEEVVLVCDKVIEEADLDGDGKLGFADFEDMIAKAPDFLSTFHIRI

SEQ ID NO: 10440 - protein, 485 aa, Human [sequence omitted]

SEQ ID NO: 10441 - protein, 87 aa, Human
GFQLFCLSGRCWARTVEMSEKKQPVDLGLLEEDDEFEEFPAEDWAGLDEDEDAHVWEDNWDDDNVEDDFSNQLRAELEKHGYKMETS

SEQ ID NO: 10442 - protein, 169 aa, Human
GERSRRRDQRPNSGSDKMAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 10443 - protein, 459 aa, Human
LAAAAHPLAGLVGGEAWIGGAKSWLSFSAGSSCMAEMATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGGNGYINDFPMGRFLRDAKLYEIGAGTSEVRRLVIGRAFNADFH

SEQ ID NO: 10444 - protein, 1212 aa, Human
AQLGSPSWLASFLPFCLPVSAEILQRGTLGTMSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 10445 - protein, 694 aa, Human
GVARKRRKAPEGTMFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQSKPNSSFRPPQKDNPPSLVAKAQSLPSDQPVGTFSPLTTSDTSSPQKSLRTAPATGQLPGRSSPAGSPRTWHAQISTSNLYLPQDPTVAKGALAGEDTGVVTHEQFKAALRMVVDQGDPRLLLDSYVKIGEGSTGIVCLAREKHSGRQVAVKMMDLRKQQRRELLFNEVVIMRDYQHFNVVEMYKSYLVGEELWVLMEFLQGGALTDIVSQVRLNEEQIATVCEAVLQALAYLHAQGVIHRDIKSDSILLTLDGRVKLSDFGFCAQISKDVPKRKSLVGTPYWMAPEVISRSLYATEVDIWSLGIMVIEMVDGEPPYFSDSPVQAMKRLRDSPPPKLKNSHKVSPVLRDFLERMLVRDPQERATAQELLDHPFLLQTGLPECLVPLIQLYRKQTSTC

SEQ ID NO: 10446 - protein, 193 aa, Human
SRSAGPAGERSAADRVMAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAER

SEQ ID NO: 10447 - protein, 492 aa, Human
TNLFCCPFAFGDSFISPYPRSITSAVIMNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 10448 - protein, 1339 aa, Human
GAPGTRGSRRAQWLAMLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNSK

SEQ ID NO: 10449 - protein, 461 aa, Human
LSSSLQRNSLQRKTCNLEKRPVIYSILYSDATGRRGMDKNIGEQLNKAYEAFRQACMDRDSAVKELQQKTENYEQRIREQQEQLSLQQTIIDKLKSQLLLVNSTQDNNYGCVPLLEDSETRKNNLTLDQPQDKVISGIAREKLPKVRRQEVSSPRKETSARSLGSPLLHERGNIEKTFWDLKEEFHKICMLAKAQKDHLSKLNIPDTATETQCSVPIQCTDKTDKQEALFKPQAKDDINRGAPSITSVTPRGLCRDEEDTSFESLSKFNVKFPPMDNDSTFLHSTPERPGILSPATSEAVCQEKFNMEFRDNPGNFVKTEETLFEIQGIDPIASAIQNLKTTDKTKPSNLVNTCIRTTLDRAACLPPGDHNALYVNSFPLLDPSDAPFPSLDSPGKAIRGPQQPIWKPFPNQDSDSVVLSGTDSELHIPRVCEFCQAVFPPSITSRGDFLRHLNSHFNGET

SEQ ID NO: 10450 - protein, 775 aa, Human
TLTSEETPTMKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 10451 - protein, 320 aa, Human
MTMSSFLINSNYIEPKFPPFEEYAQHSGSGGADGGPGGGPGYQQPPAPPTQHLPLQQPQLPHAGGGREPTASYYAPRTAREPAYPAAALYPAHGAADTAYPYGYRGGASPGRPPQPEQPPAQAKGPAHGLHASHVLQPQLPPPLQPRAVPPAAPRRCEAAPATPGVPAGGSAPACPLLLADKSPLGLKGKEPVVYPWMKKIHVSAVNPSYNGGEPKRSRTAYTRQQVLELEKEFHFNRYLTRRRRIEIAHTLCLSERQVKIWFQNRRMKWKKDHKLPNTKMRSSNSASASAGPPGKAQTQSPHLHPHPHPSTSTPVPSSI

SEQ ID NO: 10452 - protein, 148 aa, Human
FPVVGIHLSLDSTTLPSLLQLKSSPGTSARGGRAGRGITALVVPGLRWQPRLSLLRSLVSFSAALCQPAGFPLPPHTSTWSQQITQQPTGFMRAPLGKSGAPIQNTRPWNWRKSFCSTCTSPGTAGTRWLDCSTSPRGRSRSGSRTAG

SEQ ID NO: 10453 - protein, 756 aa, Human
SGSLSTGFTMTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 10454 - protein, 366 aa, Human
LFGDRWLPGLFSRWSLRWSGMARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTSASQALHSDWLARNCQPNYWRNVIPDPSKYCGPYKPPGILKQDIPIHKETEDDRGHDTIGMVVIHKTGHIAAGTSTNGIKFKIHGRVGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 10455 - protein, 485 aa, Human
RQGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAILE

SEQ ID NO: 10456 - protein, 475 aa, Human
DSPERATVMEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 10457 - protein, 601 aa, Human
SINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEARIYVPACQRPTKNASGGVQEGCGAGDTRRPEPA

SEQ ID NO: 10458 - protein, 212 aa, Human
VPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 10459 - protein, 463 aa, Human
VAVERRRGSSAGFPCSQRSRRPAEPGRGIPDRRRRGPIGRVNMDLENKVKKMGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 10460 - protein, 195 aa, Human
STAQGNLLTVFIQPRASMSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 10461 - protein, 488 aa, Human [sequence omitted]

SEQ ID NO: 10462 - protein, 488 aa, Human [sequence omitted]

SEQ ID NO: 10463 - protein, 464 aa, Human
IGQDSRLHFSRRERDTKRTGPAAGRETVFLFSKMYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 10464 - protein, 705 aa, Human
GFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNGKNEYCIEGRTSGLLLPNCSPYCLCYFYLHQEGSTVEKLLQKEEITNI

SEQ ID NO: 10465 - protein, 485 aa, Human
ISTRGAEMPPMPSAPPVHPPPDGGWGWIVVGAAFISIGFSYAFPKAVTVFFKEIQQIFHTTYSEIAWISSIMLAVMYAGGPVSSVLVNKYGSRPVVIAGGLLCCLGMVLASFSSSVVQLYLTMGFITGLGLAFNLQPALTIIGKYFYRKRPMANGLAMAGSPVFLSSLAPFNQYLFNTFGWKGSFLILGSLLLNACVAGSLMRPLGPNQTTSKSKNKTGKTEDDSSPKKIKTKKSTWEKVNKYLDFSLFKHRGFLIYLSGNVIMFLGFFAPIIFLAPYAKDQGIDEYSAAFLLSVMAFVDMFARPSVGLIANSKYIRPRIQYFFSFAIMFNGVCHLLCPLAQDYTSLVLYAVFFGLGFGSVSSVLFETLMDLVGAPRFSSAVGLVTIVECGPVLLGPPLAGKLVDLTGEYKYMYMSCGAIVVAASVWLLIGNAINYRLLAKERKEENARQKTRESEPLSKSKHSEDVNVKVSNAQSVTSERETNI

SEQ ID NO: 10466 - protein, 523 aa, Human
CSGEALSFASTLNQTMTQTLKYASRVFHRVRWAPELGASLGYREYHSARRSLADIPGPSTPSFLAELFCKGGLSRLHELQVQGAAHFGPVWLASFGTVRTVYVAAPALVEELLRQEGPRPERCSFSPWTEHRRCRQRACGLLTAEGEEWQRLRSLLAPLLLRPQAAARYAGTLNNVVCDLVRRLRRQRGRGTGPPALVRDVAGEFYKFGLEGIAAVLLGSRLGCLEAQVPPDTETFIRAVGSVFVSTLLTMAMPHWLRHLVPGPWGRLCRDWDQMFAFAQRHVERREAEAAMRNGGQPEKDLESGAHLTHFLFREELPAQSILGNVTELLLAGVDTVSNTLSWALYELSRHPEVQTALHSEITAALSPGSSAYPSATVLSQLPLLKAVVKEVLRLYPVVPGNSRVPDKDIHVGDYIIPKNTLVTLCHYATSRDPAQFPEPNSFRPARWLGEGPTPHPFASLPFGFGKRSCMGRRLAELELQMALAQILTHFEVQPEPGAAPVRPKTRTVLVPERSINLQFLDR

SEQ ID NO: 10467 - protein, 269 aa, Human
RRCCHSATMFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLGIPEQEYSCVVKMPSGEFARICRDLSHIGDAVVISCAKDGVKFSASGELGNGNIKLSQTSNVDKEEEAVTIEMNEPVQLTFALRYLNFFTKATPLSSTVTLSMSADVPLVVEYKIADMGHLKYYLAPKIEDEEGS

SEQ ID NO: 10468 - protein, 650 aa, Human
MMGIGKNTTSKSMEAGSSTEGKYEDEAKHPAFFTLPVVINGGATSSGEQDNEDTELMAIYTTENGIAEKSSLAETLDSTGSLDPQRSDMIYTIEDVPPWYLCIFLGLQHYLTCFSGTIAVPFLLADAMCVGYDQWATSQLIGTIFFCVGITTLLQTTFGCRLPLFQASAFAFLAPARAILSLDKWKCNTTDVSVANGTAELLHTEHIWYPRIREIQGAIIMSSLIEVVIGLLGLPGALLKYIGPLTITPTVALIGLSGFQAAGERAGKHWGIAMLTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 10469 - protein, 487 aa, Human
LRHGGKSPRKKQRIAKKRGPRRKASSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 10470 - protein, 823 aa, Human
RTSVQICSLATLPTSLPNRRKPSAGSFRVLCRICGGDPAPRHAVVNVRQHARRVVYAAISSCSEPGGARRFRRHPLWTAQGRRLMPSPRPVLLRGARAALLLLLPPRLLARPSLLLRRSLSAASCAPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 10471 - protein, 281 aa, Human; identical to SEQ ID NO: 8317

SEQ ID NO: 10472 - protein, 263 aa, Human [sequence omitted]

SEQ ID NO: 10473 - protein, 434 aa, Human
FLLSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 10474 - protein, 86 aa, Human
EALLTPPPHRRHTAAASVMPKHEFSVDMTCGGCAEAVSRVLNKLGGVKYDIDLPNKKVCIESEHSMDTLLATLKKTGKTVSYLGLE

SEQ ID NO: 10475 - protein, 681 aa, Human
GFCCEPETMAKPAQGAKYRGSIHDFPGFDPNQDAEALYTAMKGFGSDKEAILDIITSRSNRQRQEVCQSYKSLYGKDLIADLKYELTGKFERLIVGLMRPPAYCDAKEIKDAISGIGTDEKCLIEILASRTNEQMHQLVAAYKDAYERDLEADIIGDTSGHFQKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTPEYFAERLFKAMKGLGTRDNTLIRIMVSRSELDMLDIREIFRTKYEKSLYSMIKNDTSGEYKKTLLKLSGGDDDAAGQFFPEAAQVAYQMWELSAVARVELKGTVRPANDFNPDADAKALRKAMKGLGTDEDTIIDIITHRSNVQRQQIRQTFKSHFGRDLMTDLKSEISGDLARLILGLMMPPAHYDAKQLKKAMEGAGTDEKALIEILATRTNAEIRAINEAYKEDYHKSLEDALSSDTSGHFRRILISLATGHREEGGENLDQAREDAQVAAEILEIADTPSGDKTSLETRFMTILCTRSYPHLRRVFQEFIKMTNYDVEHTIKKEMSGDVRDAFVAIVQSVKNKPLFFADKLYKSMKGAGTDEKTLTRIMVSRSEIDLLNIRREFIEKYDKSLHQAIEGDTSGDFLKALLALCGGED

SEQ ID NO: 10476 - protein, 681 aa, Human; identical to SEQ ID NO: 10475

SEQ ID NO: 10477 - protein, 753 aa, Human
AGASVELSAPLLPVPKMMPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKEQKREERRQLKQQLEDMQKQLRQLQEKFYQIYDSTDSENDEDGNLSEDSMRSEILDARAQDSVGRSDNEMCELDPGQFIDRARALIREQEMAENKPKREGNNKERDHGPNSLQPEGKHLAETLKQELNTAMSQVVDTVVKVFSAKPSRQVPQVFPPLQIPQARFAVNGENHNFHTANQRLQCFGDVIIPNPLDTFGNVQMASSTDQTEALPLVVRKNSSDQSASGPAAGGHHQPLHQSPLSATTGFTTSTFRHPFPLPLMAYPFQSPLGAPSGSFSGKDRASPESLDLTRDTTSLRTKMSSHHLSHHPCSPAHPPSTAEGLSLSLIKSECGDLQDMSEISPYSGSAMQEGLSPNHLKKAKLMFFYTRYPSSNMLKTYFSDVKFNRCITSQLIKWFSNFREFYYIQMEKYARQAINDGVTSTEELSITRDCELYRALNMHYNKANDFEVPERFLEVAQITLREFFNAIIAGKDVDPSWKKAIYKVICKLDSEVPEIFKSPNCLQELLH

SEQ ID NO: 10478 - protein, 806 aa, Human
FGTMGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFKSSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLCLSHFSKKDTPLRNKVPGLYKSSSADSLSTTKIKPLGPARASGLSKKPASIQKRKHHNAENKPGLQIKLNELWKNFGFKKF

SEQ ID NO: 10479 - protein, 113 aa, Human
HSGFLDPCHPRLNTDSSSLTMKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 10480 - protein, 368 aa, Human
VDNSEYMGNGDFLPTRLQAQQDAVNTVCHSKTRSNPENNVGLITLDNDCEVLTTLTPDTGRILSKLHTVQPKGKITFCMGIHVAHLALKHRQGNNHKIRIIAFVGNPVEDNEKNLVKLAKCLKKEKVNVDIINFGEEEVNTEKLTAFVNTLNGKDGTGSHLVTVPPGPSLADALISFPILAGEGGAMMGLGASDFEFGVDPSADPELALVLRVFMEEQRQRQEEEARQAAAASAAEAGIATTGTEDSDDALLKMTISQQEFGHTGLPDLSSMTEEEKIVCAMQMSLQGAEFGLAESADIDASSAMDTSEPAKEEDDYDVMQDPEFLQSVLENLPGVDPNNEAIRNAVGSLASQATKDSKKDKKEEDKK

SEQ ID NO: 10481 - protein, 495 aa, Human
EEKPSMDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 10482 - protein, 557 aa, Human
REGRACRERELLSSTGRAGSWLVLTPWPQRQVLPRAFGGDMELEELGIREECGVFGCIASGEWPTQLDVPHVITLGLVGLQHRGQESAGIVTSDGSSVPTFKSHKGMGLVNHVFTEDNLKKLYVSNLGIGHTRYATTGKCELENCQPFVVETLHGKIAVAHNGELVNAARLRKKLLRHGIGLSTSSDSEMITQLLAYTPPQEQDDTPDWVARIKNLMKEAPTAYSLLIMHRDVIYAVRDPYGNRPLCIGRLIPVSDINDKEKKTSETEGWVVSSESCSFLSIGARYYREVLPGEIVEISRHNVQTLDIISRSEGNPVAFCIFEYVYFARPDSMFEDQMVYTVRYRCGQQLAIEAPVDADLVSTVPESATPAALAYAGKCGLPYVEVLCKNRYVGRTFIQPNMRLRQLGVAKKFGVLSDNFKGKRIVLVDDSIVRGNTISPIIKLLKESGAKEVHIRVASPPIKYPCFMGINIPTKEELIANKPEFDHLAEYLGANSVVYLSVEGLVSSVQEGIKFKKQKEKKHDIMIQENGNGLECFEKSGHCTACLTGKYPVELEW

SEQ ID NO: 10483 - protein, 579 aa, Human
INVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 10484 - protein, 498 aa, Human
EGWGRGRGGRSRRRQKPKAKRARAAHTGWEAAVCAASSRRGEAAVHGASQSAGSMGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 10485 - protein, 373 aa, Human
EHPNSWISGQVKKILWAIKMKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKILGYDRCDAGWLADGSVRYPISRPRRRCSPTEAAVRFVGFPDKKHKLYGVYCFRAYN

SEQ ID NO: 10486 - protein, 277 aa, Human
RLLSEAPCPRSRRRFQMNPEWGQAFVHVAVAGGLCAVAVFTGIFDSVSVQVGYEHYAEAPVAGLPAFLAMPFNSLVNMAYTLLGLSWLHRGGAMGLGPRYLKDVFAAMALLYGPVQWLRLWTQWRRAAVLDQWLTLPIFAWPVAWCLYLDRGWRPWLFLSLECVSLASYGLALLHPQGFEVALGAHVVAAVGQALRTHRHYGSTTSATYLALGVLSCLGFVVLKLCDHQLARWRLFQCLTGHFWSKVCDVLQFHFAFLFLTHFNTHPRFHPSGGKTR

SEQ ID NO: 10487 - protein, 724 aa, Human
EAPAGPGPAAAAMAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 10488 - protein, 421 aa, Human
LPAARASETSRPRRREPARRTEQSGAPVVQRVGSRSPMEGLGRSCLWLRRELSPPRPRLLLLDCRSRELYESARIGGALSVALPALLLRRLRRGSLSVRALLPGPPLQPPPPAPVLLYDQGGGRRRRGEAEAEAEEWEAESVLGTLLQKLREEGYLAYYLQGGFSRFQAECPHLCETSLAGRAGSSMAPVPGPVPVVGLGSLCLGSDCSDAESEADRDSMSCGLDSEGATPPPVGLRASFPVQILPNLYLGSARDSANLESLAKLGIRYILNVTPNLPNFFEKNGDFHYKQIPISDHWSQNLSRFFPEAIEFIDEALSQNCGVLVHCLAGVSRSVTVTVAYLMQKLHLSLNDAYDLVKRKKSNISPNFNFMGQLLDFERSLRLEERHSQEQGSGGQASAASNPPSFFTTPTSDGAFELAPT

SEQ ID NO: 10489 - protein, 189 aa, Human
RVHGSSFSFPLGREEAMAAMASLGALALLLLSSLSRCSAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 10490 - protein, 1912 aa, Human
TERMCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHITVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 10491 - protein, 2045 aa, Human
LLPTAPFPGTMASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSAPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVHGCSNPPCETHETGTTNTATTAMSSVGANHQRDARRACAAGTPAVIRISVATGALEAAQGSKSQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMAFLVSSVSLDPGAGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESKRLRANWCWGGGGTQGGLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACGRGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 10492 - protein, 960 aa, Human
RGSSGVRRRGREAAMAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEATAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNEPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 10493 - protein, 250 aa, Human
LRLHDPLGPASPAAVMNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 10494 - protein, 446 aa, Human
PANSSTFWYTVGEMRQSHQLPLVGLLLFSFIPSQLCEICEVSEENYIRLKPLLNTMIQSNYNRGTSAVNVVLSLKLVGIQIQTLMQKMIQQIKYNVKSRLSDVSSGELALIILALGVCRNAEENLIYDYHLIDKLENKFQAEIENMEAHNGTPLTNYYQLSLDVLALCLFNGNYSTAEVVNHFTPENKNYYFGSQFSVDTGAMAVLALTCVKKSLINGQIKADEGSLKNISIYTKSLVEKILSEKKENGLIGNTFSTGEAMQALFVSSDYYNENDWNCQQTLNTVLTEISQGAFSNPNAAAQVLPALMGKTFLDINKDSSCVSASGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 10495 - protein, 395 aa, Human
AAEQPGNGGGARSPRVSRMASASTSKYNSHSLENESIKRTSRDGVNRDLTEAVPRLPGETLITDKEVIYICPFNGPIKGRVYITNYRLYLRSLETDSSLILDVPLGVISRIEKMGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKATRFDRSHSSSRQSFFREEFSACALQ

SEQ ID NO: 10496 - protein, 228 aa, Human
WRQLARGWGALSRASCPALPRLANNTVRMAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 10497 - protein, 485 aa, Human
NEFFWKPVWVTGKMTHMLNAAADRVKWTRSSAAKRAACLVAAAYALKTLYPIIGKRLKQSGHGKKKAAAYPAAENTEILHCTETICEKPSPGVNADFFKQLLELRKILFPKLVTTETGWLCLHSVALISRTFLSIYVAGLDGKIVKSIVEKKPRTFIIKLIKWLMIAIPATFVNSAIRYLECKLALAFRTRLVDHAYETYFTNQTYYKVINMDGRLANPDQSLTEDIMMFSQSVAHLYSNLTKPILDVMLTSYTLIQTATSRGASPIGPTLLAGLVVYATAKVLKACSPKFGKLVAEEAHRKGYLRYVHSRIIANVEEIAFYRGHKVEMKQLQKSYKALADQMNLILSKRLWYIMIEQFLMKYVWSSSGLIMVAIPIITATGFADGEDGQKQVMVSERTEAFTTARNLLASGADAIERIMSSYKEVTELAGYTARVYNMFWVFDEVKRGIYKRTAVIQESESHSKNGAKVELPLSDTLAIKGKSY

SEQ ID NO: 10498 - protein, 1193 aa, Human
MVAAAAATEARLRRRTAATAALAGRSGGPHCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQ

SEQ ID NO: 10499 - protein, 640 aa, Human
RGFPGWCLSPASLAPRPPRIPLLPRAWPCGSSSLPPSPPPHPSPAASLGPASCAGVCWLPCARPSSQPSAGPAAMEVPQPEPAPGSALSPAGVCGGAQRPGHLPGLLLGSHGLLGSPVRAAASSPVTTLTQTMHDLAGLGSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 10500 - protein, 640 aa, Human; identical to SEQ ID NO: 10499

SEQ ID NO: 10501 - protein, 640 aa, Human; identical to SEQ ID NO: 10499

SEQ ID NO: 10502 - protein, 640 aa, Human; identical to SEQ ID NO: 10499

SEQ ID NO: 10503 - protein, 1709 aa, Human
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVPTGVPEGTSYRWYRDGQPLQESTSATLRFAAITLTQAGAYHCQAQAPGSATTSLAVPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQLLWVLGLLVGLLLLLLGLGACYTWRRRRVCKQSMGENSVEMAFQKETTQLIDPDAATCETSTCAPPLG

SEQ ID NO: 10504 - protein, 545 aa, Human [sequence omitted]

SEQ ID NO: 10505 - protein, 464 aa, Human
HWEMTLPGGPTGMARPGGARPCSPGLERAPRRSVGELRLLFEARCAAVAAAAAAGEPRARGAKRRGGQVPNGLPRAPPAPVIPQLTVTAEEPDVPPTSPGPPERERDCLPAAGSSHLQQPRRLSTSSVSSTGSSSLLEDSEDDLLSDSESRSRGNVQLEAGEDVGQKNHWQKIRTMVNLPVISPFKKRYAWVQLAGHTGSFKAAGTSGLILKRCSEPERYCLARLMADALRGCVPAFHGVVERDGESYLQLQDLLDGFDGPCVLDCKMGVRTYLEEELTKARERPKLRKDMYKKMLAVDPEAPTEEEHAQRAVTKPRYMQWREGISSSTTLGFRIEGIKKADGSCSTDFKTTRSREQVLRVFEEFVQGDEEVLRRYLNRLQQIRDTLEVSEFFRRHEVIGSSLLFVHDHCHRAGVWLIDFGKTTPLPDGQILDHRRPWEEGNREDGYLLGLDNLIGILASLAER

SEQ ID NO: 10506 - protein, 164 aa, Human
CQNLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 10507 - protein, 187 aa, Human [sequence omitted]

SEQ ID NO: 10508 - protein, 278 aa, Human
LRRANSSLALPLTHAHTRLEMAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 10509 - protein, 487 aa, Human
SSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 10510 - protein, 99 aa, Human
SSSGGEEKPEVLGVPSEICLQFSPSRCENGDKHPGAVSQLHYCLDYGYSYVAPCEVLSVLRGHAMVLGLTEMLRSCLLYALRPHCCHCHRMPFSIRGHL

SEQ ID NO: 10511 - protein, 668 aa, Human
TLASAGRTPPPPTLPAPRTPYSTSSFWPGEAHDVDMPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 10512 - protein, 266 aa, Human
DIMESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYVCDLEGNRVKGPEKEEKLRQAVKQVLKCDVTQSQPLGAVPLPPADCVLSTLCLDAACPDLPTYCRALRNLGSLLKPGGFLVIMDALKSSYYMIGEQKFSSLPLGREAVEAAVKEAGYTIEWFEVISQSYSSTMANNEGLFSLVARKLSRPL

SEQ ID NO: 10513 - protein, 382 aa, Human
TDKVLKEKRKLFIRSMGEGTINGLLDELLQTRVLNKEEMEKVKRENATVMDKTRALIDSVIPKGAQACQICITYICEEDSYLAGTLGLSAAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 10514 - protein, 323 aa, Human
GQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 10515 - protein, 449 aa, Human
DLWFFYLKDTMFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 10516 - protein, 167 aa, Human [sequence omitted]

SEQ ID NO: 10517 - protein, 373 aa, Human
RHPHTAYFPSGAMSGNGNAAATAEENSPKMRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQGALGVEVRAKDQDILDLVGVLHDPETLLRCIAERAFLRHLEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 10518 - protein, 467 aa, Human
RRDHTAMPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 10519 - protein, 455 aa, Human
DSWLLQGCGRWSSVLLTQVQRAFSLVLQLLLYRRRRRRRRLLCGVMVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQECSLDDDTILIPIIVGAGLSGLIIVIVIAYVIGRRKSYAGYQTL

SEQ ID NO: 10520 - protein, 455 aa, Human; identical to SEQ ID NO: 10519

SEQ ID NO: 10521 - protein, 333 aa, Human
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 10522 - protein, 256 aa, Human
DRMAWQGLVLAACLLMFPSTTADCLSRCSLCAVKTQDGPKPINPLICSLQCQAALLPSEEWERCQSFLSFFTPSTLGLNDKEDLGSKSVGEGPYSELAKLSGSFLKELEKSKFLPSISTKENTLSKSLEEKLRGLSDGFREGAESELMRDAQLNDGAMETGTLYLAEEDPKEQVKRYGGFLRKYPKRSSEVAGEGDGDSMGHEDLYKRYGGFLRRIRPKLKWDNQKRYGGFLRRQFKVVTRSQEDPNAYSGELFDA

SEQ ID NO: 10523 - protein, 226 aa, Human
ARNMNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 10524 - protein, 248 aa, Human
TFSRIHLFQRSEFRPLYHWQQDVTMEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNMWDFVLSPDEINTIYLGGPFSPNVLNWRALKYEVQGEVFTKPQLWP

SEQ ID NO: 10525 - protein, 376 aa, Human
QDNHIKMVGKLKQNLLLACLVISSVTVFYLGQHAMECHHRIEERSQPVKLESTRTTVRTGLDLKANKTFAYHKDMPLIFIGGVPRSGTTLMRAMLDAHPDIRCGEETRVIPRILALKQMWSRSSKEKIRLDEAGVTDEVLDSAMQAFLLEIIVKHGEPAPYLCNKDPFALKSLTYLSRLFPNAKFLLMVRDGRASVHSMISRKVTIAGFDLNSYRDCLTKWNRAIETMYNQCMEVGYKKCMLVHYEQLVLHPERWMRTLLKFLQIPWNHSVLHHEEMIGKAGGVSLSKVERSTDQVIKPVNVGALSKWVGKIPPDVLQDMAVIAPMLAKLGYDPYANPPNYGKPDPKIIENTRRVYKGEFQLPDFLKEKPQTEQVE

SEQ ID NO: 10526 - protein, 153 aa, Human
NQMFSTKALLLAGLISTALAGPWANICAGKSSNEIRTCDRHGCGQYSAQRSQRPHQGVDILCSAGSTVYAPFTGMIVGQEKPYQNKNAINNGVRISGRGFCVKMFYIKPIKYKGPIKKGEKLGTLLPLQKVYPGIQSHVHIENCDSSDPTAYL

SEQ ID NO: 10527 - protein, 253 aa, Human
GRGISWGCYQGRDCEEGRTLLGQKEHILRRRGPCLPHQALGHQEDPHLQASLAFQGERGPCSSFIMNWHMIISGLIVVVLKVVGMTLFLLYFPQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 10528 - protein, 224 aa, Human
IMRDEIATTVFFVTRLVKKHDKLSKQQIEDFAEKLMTILFETYRSHWHSDCPSKGQAFRCIRINNNQNKDPILERACVESNVDFSHLGLPKEMTIWVDPFEVCCRYGEKNHPFTVASFKGRWEEWELYQQISYAVSRASSDVSSGTSCDEESCSKEPRVIPKVSNPKSIYQVENLKQPFQSWLQIPRKKNVVDGRVGLLGNTYHGSQKHPKCYRPAMHRLDRIL

SEQ ID NO: 10529 - protein, 297 aa, Human
KAQETASAQAVAPLEENTPRSHIKEAKLSASKRKGNILSQAMLWQKPTAPEQAPAPARPYQGVRVKEPVKELLRRKRGHASSGAAPAPTAVVLPHQPLATYTTVGPSCLDMEGSVSAVTEEAALCAGWLSQPTPATLQPLAPWTPYTEYVPHEAVSCPYSADMYVQPVCPSYTVVGPSSVLTYASPPLITNVTTRSSATPAVGPPLEGPEHQAPLTYFPWPQPLSTLPTSTLQYQPPAPALPGPQFVQLPISIPEPVLQDMEDPRRAASSLTIDKLLLEEEDSDAYALNHTLSVEGF

SEQ ID NO: 10530 - protein, 611 aa, Human
AVTSSRRRKNMAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 10531 - protein, 324 aa, Human
PRVMAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 10532 - protein, 495 aa, Human
EEKASMEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 10533 - protein, 495 aa, Human; identical to SEQ ID NO: 10532

SEQ ID NO: 10534 - protein, 447 aa, Human
KASMDSLVVLVLCLSCLLLLSLWRQSSGRGKLPPGPTPLPVIGNILQIGIKDISKSLTNLSKVYGPVFTLYFGLKPIVVLHGYEAVKEALIDLGEEFSGRGIFPLAERANRGFGIVFSNGKKWKEIRRFSLMTLRNFGMGKRSIEDRVQEEARCLVEELRKTKASPCDPTFILGCAPCNVICSIIFHKRFDYKDQQFLNLMEKLNENIKILSSPWIQICNNFSPIIDYFPGTHNKLLKNVAFMKSYILEKVKEHQESMDMNNPQDFIDCFLMKMEKEKHNQPSEFTIESLENTAVDLFGAGTETTSTTLRYALLLLLKHPEVTAKVQEEIERVIGRNRSPCMQDRSHMPYTDAVVHEVQRYIDLLPTSLPHAVTCDIKFRNYLIPKGTTILISLTSVLHDNKEFPNPEMFDPHHFLDEGGNFKKSKYFMPFSAGNINLFPFVFQGTR

SEQ ID NO: 10535 - protein, 1437 aa, Human
FLIVVPAVVLIMLLPSDVARLVLGYLQQENLISTCQTFILESSDLKEYAEHCTDEGFIPACLLSLFGKNLTTILNEYVAMKTKETSNNVPAIMSSLWKKLDHTLSQIRSMQSSPRFAGSQRARTRTGIAEIKRQRKLASQTAPASAELLTLPYLSGQFTTPPSTGTQVTRPSGQISDPSRSYFVVVNHSQSQDTVTTGEALNVIPGAQEKKAHASLMSPGRRKSESQRKSTTLSGPHSTIRNFQDPNAFAVEKQMVIENAREKILSNKSLQEKLAENINKFLTSDNNIAQVPKQTDNNPTEPETSIDEFLGLPSEIHMSEEAIQDILEQTESDPAFQALFDLFDYGKTKNNKNISQSISSQPMESNPSIVLADETNLAVKGSFETEESDGQSGQPAFCTSYQNDDPLNALKNSNNHDVLRQEDQENFSQISTSIQKKAFKTAVPTEQKCDIDITFESVPNLNDFNQRGNSNAECNPHCAELYTNQMSTETEMAIGIEKNSLSSNVPSESQLQPDQPDIPITSFVSLGCEANNENLILSGKSSQLLSQDTSLTGKPSKKSQFCENSNDTVKLKINFHGSKSSDSSEVHKSKIEINVLEPVMSQLSNCQDNSCLQSEILPVSVESSHLNVSGQVEIHLGDSLSSTKQPSNDSASVELNHTENEAQASKSENSQEPSSSVKEENTIFLSLGGNANCEKVALTPPEGTPVENSHSLPPESVCSSVGDSHPESQNTDDKPSSNNSAEIDASNIVSLKVIISDDPFVSSDTELTSAVSSINGENLPTIILSSPTKSPTKNAELVKCLSSEETVGAVVYAEVGDSASMEQSLLTFKSEDSAVNNTQNEDGIAFSANVTPCVSKDGGYIQLMPATSTAFGNSNNILIATCVTDPTALGTSVSQSNVVVLPGNSAPMTAQPLPPQLQTPPRSNSVFAVNQAVSPNFSQGSAIIIASPVQPVLQGMVGMIPVSVVGQNGNNFSTPPRQVLHMPLTAPVCNRSIPQFPVPPKSQKAQGLRNKPCIGKQVNNLVDSSGHSVGCHAQKTEVSDKSIATDLGKKSEETTVPFPEESIVPAAKPCHRRVLCFDSTTAPVANTQGPNHKMVSQNKERNAVSFPNLDSPNVSSTLKPPSNNAIKREKEKPPLPKILSKSESAISRHTTIRETQSEKKVSPTEIVLESFHKATANKENELCSDVERQKNPENSKLSIGQQNGGLRSEKSIASLQEMTKKQGTSSNNKNVLSVGTAVKDLKQEQTKSASSLITTEMLQDIQRHSSVSRLADSSDLPVPRTPGSGAGEKHKEEPIDIIKAPSSRRFSEDSSTSKVMVPPVTPDLPACSPASETGSENSVNMAAHTLMILSRAAISRTTSATPLKDNTQQFRASSRSTTKKRKIEELDERERNSRPSSKNLTNSSIPMKKKKIKAKKEASQFISSRNGCRQIFVIIAL

SEQ ID NO: 10536 - protein, 371 aa, Human
LERGVGGCRVFSCLGSYPGIEGAGLALLAGLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKNWNSSVPRSSDFEDSAHLMQPVHNKPVKQGPRYNLHQIQGHSAPRHFHTQTQSLQQSVRKFSENPHVYQRHHLPPPGPPGEDYSHRRYSWNVKPNASRAAQDRRRWYPYNYSRLSYPACWEWTQ

SEQ ID NO: 10537 - protein, 183 aa, Human
LPPQVADTMLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 10538 - protein, 524 aa, Human
QVANLACSISNNEEGVKLVRMAATQIDSLCPQVINAALTLAARPQSKVAQDNMDVFKDQWEKQVRVLTEAVDDITSVDDFLSVSENHILEDVNKCVIALQEGDVDTLDRTAGAIRGRAARVIHIINAEMENYEAGVYTEKVLEATKLLSETVMPRFAEQVEVAIEALSANVPQPFEENEFIDASRLVYDGVRDIRKAVLMIRTPEELEDDSDFEQEDYDVRSRTSVQTEDDQLIAGQSARAIMAQLPQEEKAKIAEQVEIFHQEKSKLDAEVAKWDDSGNDIIVLAKQMCMIMMEMTDFTRGKGPLKNTSDVINAAKKIAEAGSRMDKLARAVADQCPDSACKQDLLAYLQRIALYCHQLNICSKVKAEVQNLGGELIVSGTGVQSTFTTFYEVDCDVIDGGRASQLSTHLPTCAEGAPIGSGSSDSSMLDSATSLIQAAKNLMNAVVLTVKASYVASTKYQKVYGTAAVNSPVVSWKMKAPEKKPLVKREKPEEFQTRVRRGSQKKHISPVQALSEFKAMDSF

SEQ ID NO: 10539 - protein, 399 aa, Human
RSTMVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTSLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 10540 - protein, 463 aa, Human
TKLVGSLRMFCPCLLSTRKKILWEWLHFTTGRMENLSMSMMNTLPRQTLTQFLGWSLLNTDTYDKMNKLENRKDIAQEMLMNQTKATPEEIKSILKFQEKLNVDVIDDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKEFSRFHKEITPMLSGLQNNRVEWKSLADEYDAKMKVIEEEAKKQEGGAEK

SEQ ID NO: 10541 - protein, 429 aa, Human
QTGREVAGQRSRTRGSSATEDPSDLIPGSRLQALLAFYRFHPRDYLPKTEPLYQEKVRELGQPGLSRAPKMRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCVKQ

SEQ ID NO: 10542 - protein, 382 aa, Human
SACAWRLPSPGPSAMWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 10543 - protein, 187 aa, Human
CTRRLPNNRQRTPLAMASNFKKANMASSSQRKRMSPKPELTEEQKQEIREAFDLFDADGTGTIDVKELKVAMRALGFEPKKEEIKKMISEIDKEGTGKMNFGDFLTVMTQKMSEKDTKEEILKAFKLFDDDETGKISFKNLKRVAKELGENLTDEELQEMIDEADRDGDGEVSEQEFLRIMKKTSLY

SEQ ID NO: 10544 - protein, 437 aa, Human
PSWANPLGGGSSADSRLTREGSKGWRSGPGVQWVQPACELRPDRGAPTDGKEKLITNGTIFCFEMEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQLSRDSTLGGKAFHITNDEPIPFWTFLSRILTGLNYEAPKYHIPYWVAYYLALLLSLLVMVISPVIQLQPTFTPMRVALAGTFHYYSCERAKKAMGYQPLVTMDDAMERTVQSFRHLRRVK

SEQ ID NO: 10545 - protein, 1179 aa, Human
EGLTGSMGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 10546 - protein, 202 aa, Human
FPPAKTTTGEPSRRQLGNMKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKDCPYGTFGMDCRETCNCQSGICDRGTGKCLKFPFFQYSVTKSSNRFVSLTEHDMASGDGNIVREEVVKENAAGSPVMRKWLNPR

SEQ ID NO: 10547 - protein, 588 aa, Human
QFLCRWILFPARGRSALESPNSSYAKARDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVRKGTQCT

SEQ ID NO: 10548 - protein, 373 aa, Human
PVKMLPRLICINDYEQHAKSVLPKSIYDYYRSGANDEETLADNIAAFSRWKLYPRMLRNVAETDLSTSVLGQRVSMPICVGATAMQRMAHVDGELATVRACQSLGTGMMLSSWATSSIEEVAEAGPEALRWLQLYIYKDREVTKKLVRQAEKMGYKAIFVTVDTPYLGNRLDDVRNRFKLPPQLRMKNFETSTLSFSPEENFGDDSGLAAYVAKAIDPSISWEDIKWLRRLTSLPIVAKGILRGDDAREAVKHGLNGILVSNHGARQLDGVPATIDVLPEIVEAVEGKVEVFLDGGVRKGTDVLKALALGAKAVFVGRPIVWGLAFQGEKGVQDVLEILKEEFRLAMALSGCQNVKVIDKTLVRKNPLAVSKI

SEQ ID NO: 10549 - protein, 181 aa, Human
AGSARNKAPGQGDFCSAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVPILIPCHRVVCSSGAVGNYSGGLAVKEWLLAHEGHRLGKPGLGGSSGLAGAWLKGAGATSGSPPAGRN

SEQ ID NO: 10550 - protein, 336 aa, Human
KERRGVEEARDWRDQSSPMAAQGCAASRLLQLLLQLLLLLLLLAAGGARARWRGEGTSAHLRDIFLGRCAEYRALLSPEQRNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSAAAATQRKAPSLYTEQRAGLIIPLFLVLASRTQL

SEQ ID NO: 10551 - protein, 279 aa, Human
RPPRVPSWRGWPAGAGRGAPARGIRSCGSRAGRSRMAAAAAAGEARRVLVYGGRGALGSRCVQAFRARNWWVASVDVVENEEASASIIVKMTDSFTEQADQVTAEVGKLLGEEKVDAILCVAGGWAGGNAKSKSLFKNCDLMWKQSIWTSTISSHLATKHLKEGGLLTLAGAKAALDGTPGMIGYGMAKGAVHQLCQSLAGKNSGMPPGAAAIAVLPVTLDTPMNRKSMPEADFSSWTPLEFLVETFHDWITGKNRPSSGSLIQVVTTEGRTELTPAYF

SEQ ID NO: 10552 - protein, 931 aa, Human
SSGCWRRRCPTASPSPALRCPVLSRRGRIGVDMAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGGKF

SEQ ID NO: 10553 - protein, 1032 aa, Human
DLDLCIRENIMNNNWNVCFFLFCPSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 10554 - protein, 248 aa, Human
ASEEANPAGIRAIRTATMTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGMRGLL

SEQ ID NO: 10555 - protein, 163 aa, Human
QSRTLDPAHPHHGRPQPRLLSARPPGADLRLLHPELPPGRQEGRAGPRRAQVPPLRPRGQRPLLRAQYLLRGRAGLLRGHRRSAALPGGELPAVALPVRPEGVRERGPLRGLGPLLQPGRLPRRPCLRRGSHLLPALKLDGSEHPRSAPLASPIATPEMVKIK

SEQ ID NO: 10556 - protein, 199 aa, Human
SGYKTISAMQTIKCVVVGDGAVSKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKPAKNKQKPITPETAEKLARDLKAVKYVECSALTKKGLKNVFDEAILAALEPPEPKKSRRCVLL

SEQ ID NO: 10557 - protein, 102 aa, Human
GGSESSTMTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 10558 - protein, 440 aa, Human
GTPQKLASVGLGSSDLNNIPAMAGDSRNAMNQDMEIGVTPWDPKKIPKQARDYVPIATDRTRLLAEGKKPRQRYMEKSGKCNVHHGNVQETYRYLSDLFTTLVDLKWRFNLLVFTMVYTVTWLFFGFIWWLIAYIRGDLDHVGDQEWIPCVENLSGFVSAFLFSIETETTIGYGFRVITEKCPEGIILLLVQAILGSIVNAFMVGCMFVKISQPKKRAETLMFSNNAVISMRDEKLCLMFRVGDLRNSHIVEASIRAKLIKSRQTKEGEFIPLNQTDINVGFDTGDDRLFLVSPLIISHEINEKSPFWEMSQAQLHQEEFEVVVILEGMVEATGMTCQARSSYMDTEVLWGHRFTPVLTLEKGFYEVDYNTFHDTYETNTPSCCAKELAEMKREGRLLQYLPSPPLLGGCAEAGLDAEAEQNEEDEPKGLGGSREARGSV

SEQ ID NO: 10559 - protein, 470 aa, Human
EALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYYYGLLAEAHPAHLLDALDSTGHMWP

SEQ ID NO: 10560 - protein, 480 aa, Human
NSPQASPFKMHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 10561 - protein, 175 aa, Human
IASFPRKQQMADDAGAAGGHGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVR

SEQ ID NO: 10562 - protein, 990 aa, Human
PAPPSPAPDPGGGDPSGPATFNTHFLLPLPLYSRNPLLLPFSLLPGDGGGEKGSPVVMTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 10563 - protein, 169 aa, Human
MAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 10564 - protein, 637 aa, Human
KGGCVSQWKAAAGFLFCVMVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 10565 - protein, 237 aa, Human
ETSADMAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATS

SEQ ID NO: 10566 - protein, 237 aa, Human; identical to SEQ ID NO: 10565

SEQ ID NO: 10567 - protein, 492 aa, Human
MGDAPSPEEKLHLITRNLQEVLGEEKLKEILKERELKIYWGTATTGKPHVAYFVPMSKIADFLKAGCEVTILFADLHAYLDNMKAPWELLELRVSYYENVIKAMLESIGVPLEKLKFIKGTDYQLSKEYTLDVYRLSSVVTQHDSKKAGAEVVKQVEHPLLSGLLYPGLQALDEEYLKVDAQFGGIDQRKIFTFAEKYLPALGYSKRVHLMNPMVPGLTGSKMSSSEEESKIDLLDRKEDVKKKLKKAFCEPGNVENNGVLSFIKHVLFPLKSEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQ

SEQ ID NO: 10568 - protein, 340 aa, Human
ETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 10569 - protein, 734 aa, Human
LDNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 10570 - protein, 727 aa, Human
EERPATMGQGEPSQRSTGLAGLYAAPAASPVFIKGSGMDALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 10571 - protein, 634 aa, Human
LEVALTDLQSSRNNVRHHTEEITVDHLLVRRGQAFNLTLYFRNRSFQPGLDNIIFVVETEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 10572 - protein, 466 aa, Human
RRPGEPPLIKGWLPYLGVVLNLRKDPLRFMKTLQKQHGDTFTVLLGGKYITFILDPFQYQLVIKNHKQLSFRVFSNKLLEKAFSISQLQKNHDMNDELHLCYQFLQGKSLDILLESMMQNLKQVFEPQLLKTTSWDTAELYPFCSSIIFEITFTTIYGKVIVCDNNKFISELRDDFLKFDDKFAYLVSNIPIELLGNVKSIREKIIKCFSSEKLAKMQGWSEVFQSRQDVLEKYYVHEDLEIGAHHLGFLWASVANTIPTMFWAMYYLLRHPEAMAAVRDEIDRLLQSTGQKKGSGFPIHLTREQLDSLICLESSIFEALRLSSYSTTIRFVEEDLTLSSETGDYCVRKGDLVAIFPPVLHGDPEIFEAPEEFRYDRFIEDGKKKTTFFKRGKKLKCYLMPFGTGTSKCPGRFFALMEIKQLLVILLTYFDLEIIDDKPIGLNYSRLLFGIQYPDSDVLFRYKVKS

SEQ ID NO: 10573 - protein, 337 aa, Human
PQPPPARRAFERRREAASAMASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKNFTMNEKLKKFFNVLTTNTDGKIEFISTMEGYKYPVYGVQWHPEKAPYEWKNLDGISHAPNAVKTAFYLAEFFVNEARKNNHHFKSESEEEKALIYQFSPIYTGNISSFQQCYIFD

SEQ ID NO: 10574 - protein, 429 aa, Human
MAGSGAWKRLKSMLRKDDAPLFLNDTSAFDFSDEAGDEGLSRFNKLRVVVADDGSEAPERPVNGAHPTLQADDDSLLDQDLPLTNSQLSLKVDSCDNCSKQREILKQRKVKARLTIAAVLYLLFMIGELVGGYIANSLAIMTDALHMLTDLSAIILTLLALWLSSKSPTKRFTFGFHRLEVLSAMISVLLVYILMGFLLYEAVQRTIHMNYEINGDIMLITAAVGVAVNVIMGFLLNQSGHRHSHSHSLPSNSPTRGSGCERNHGQDSLAVRAAFVHALGDLVQSVGVLIAAYIIRFKPEYKIADPICTYVFSLLVAFTTFRIIWDTVVIILEGVPSHLNVDYIKEALMKIEDVYSVEDLNIWSLTSGKSTAIVHIQLIPGSSSKWEEVQSKANHLLLNTFGMYRCTIQLQSYRQEVDRTCANCQSSSP

SEQ ID NO: 10575 - protein, 302 aa, Human
GSKMAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMPPGLNFDLDALNLSGPPGASGEQCLIM

SEQ ID NO: 10576 - protein, 137 aa, Human
ALSSRGVMAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 10577 - protein, 137 aa, Human; identical to SEQ ID NO: 10576

SEQ ID NO: 10578 - protein, 431 aa, Human
PLQDPRRRLGAQRRAAGGSSSGPRRTPGARSARPDAAAMAQENAAFSPGQEEPPRRRGRQRYVEKDGRCNVQQGNVRETYRYLTDLFTTLVDLQWRLSLLFFVLAYALTWLFFGAIWWLIAYGRGDLEHLEDTAWTPCVNNLNGFVAAFLFSIETETTIGYGHRVITDQCPEGIVLLLLQAILGSMVNAFMVGCMFVKISQPNKRAATLVFSSHAVVSLRDGRLCLMFRVGDLRSSHIVEASIRAKLIRSRQTLEGEFIPLHQTDLSVGFDTGDDRLFLVSPLVISHEIDAASPFWEASRRALERDDFEIVVILEGMVEATGMTCQARSSYLVDEVLWGHRFTSVLTLEDGFYEVDYASFHETFEVPTPSCSARELAEAAARLDAHLYWSIPSRLDEKVEEEGAGEGAGGEAGADKEQNGCLPPPESESKV

SEQ ID NO: 10579 - protein, 354 aa, Human
MGPRAVPGLRLALLLLLVLGTPKSGVQGQEGLDFPEYDGVDRVINVNAKNYKNVFKKYEVLALLYHEPPEDDKASQRQFEMEELILELAAQVLEDKGVGFGLVDSEKDAAVAKKLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 10580 - protein, 568 aa, Human
RRRGGSRSPESGRVAEEMPLSTAGILSSSSAASNRSRNKARYRTKAVSSEVDESLFGDIKSPAQGQSDSPIVLLRDKHTLQKTLTALGLDRKPETIQLITRDMVRELIVPTEDPSGESLIISPEEFERIKWASHVLTREELEARDQAFKKEKEATMDAVMTRKKIMKQKEMVWNNNKKLSDLEEVAKERAQNLLQRANKLRMEQEEELKDMSKIILNAKCHAIRDAQILEKQQIQKELDTEEKRLDQMMEVERQKSIQRQEELERKRREERIRGRRQIVEQMEKNQEERSLLAEQREQEKEQMLEYMEQLQEEDLKDMERRQQQKLKMQAEIKRINDENQKQKAELLAQEKLADQMVMEFTKKKMAREAEFEAEQERIRREKEKEIARLRAMQEKAQDYQAEQDALRAKRNQEVADREWRRKEKENARKKMETEAELRKSRLEQVAFKEHALAVQVQRDRDEFERILRAQREQIEKERLEEEKKATGRLQHANELRRQVRENQQKEVQNRIATFEEGRRLKEEAQKRRERIDEIKRKKLEELRATGLPEKYCIEAERKANILPATSVN

SEQ ID NO: 10581 - protein, 436 aa, Human
ESLAYLTAATHGLDEEAESLKETFDPEKETIPDIDPNAKLLQPPAPIMPLDTNWPLLTGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTT

SEQ ID NO: 10582 - protein, 443 aa, Human
VGSSSFRGGLGGGYSGASGMGGITAVMVNQSLLSPLVLEVDPNIQAVCTQEKEQIKTLNNKFASFIDKVQFLEQQNKMLETKWSLLQQQKTARSNMDNMFESYINNLRRQLETLGQEKLKLEAELGNMQRLVEDFKNKYEDEINKHTEMENEFVLIKKDVDEAYMNKVELESRLEGLTDEINFLRQLYEKEIRELQSQISDTSVVLSMDNSRSLDMDSIIAEVKAQYEDIANQRRAEAESMYQIKYEELQSLAGKHGDDLWRTKTEISEMNWNISQLQAEIEGLKGQRASLEAAIADAEQRGELAIKDANAKLSELEAALQRAKQDMARQLREYQELMNVKLALDIEIATYRKLLEGKESRLKSGMQNMSIHTKTTSGYAGGLSSAYGGLTSPGLSYGLGSSFGSGAGSSSLSRTSSSRAVVVKKIETCDGKLVSESSDILPK

SEQ ID NO: 10583 - protein, 749 aa, Human
DSQPAEHPHTHSGVGAQLPVYLVSLVQPGALPRPPQAGVDMAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 10584 - protein, 168 aa, Human
LGPAGGHGCHTLGPDMMASMRVVKELEDLQKKPPPYLRNLSSDDANVLVWHALLLPDQPPYHLKAFNLRISFPPEYPFKPPMIKFTTKIYHPNVDENGQICLPIISSENWKPCTKTCQVLEALNVLVNRPNIREPLRMDLADLLTQNPELFRKNAEEFTLRFGVDRPS

SEQ ID NO: 10585 - protein, 289 aa, Human
VSPEHSLSMNCISDFFTYETTKSVVVKSWTIGIINRVVQLLIISYFVGWVFLHEKAYQVRDTAIESSVVTKVKGSGLYANRVMDVSDYVTPPQGTSVFVIITKMIVTENQMQGFCPESEEKYRCVSDSQCGPERLPGGGILTGRCVNYSSVLRTCEIQGWCPTEVDTVETPIMMEAENFTIFIKNSIRFPLFNFEKGNLLPNLTARDMKTCRFHPDKDPFCPILRVGDVVKFAGQDFAKLARTGGVLGIKIGWVCDLDKAWDQCIPKYSFTRLDSVSEKSSVSPGYNFR

SEQ ID NO: 10586 - protein, 520 aa, Human
SLHWSCLVTRSLESADVAAQMASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 10587 - protein, 624 aa, Human
LRSYEDMIGEEVPSDQYYWAPLAQHERGSLASLDSLRKGGPPPPNWRQPELPEVIAMLGFRLDAVKSNAAAYLQHLCYRNDKVKTDVRKLKGIPVLVGLLDHPKKEVHLGACGALKNISFGRDQDNKIAIKNCDGVPALVRLLRKARDMDLTEVITGTLWNLSSHDSIKMEIVDHALHALTDEVIIPHSGWEREPNEDCKPRHIEWESVLTNTAGCLRNVSSERSEARRKLRECDGLVDALIFIVQAEIGQKDSDSKLVENCVCLLRNLSYQVHREIPQAERYQEAAPNVANNTGPHAASCFGAKKGKGKKPIEDPANDTVDFPKRTSPARGYELLFQPEVVRIYISLLKESKTPAILEASAGAIQNLCAGRWTYGRYIRSALRQEKALSAIADLLTNEHERVVKAASGALRNLAVDARNKELIGKHAIPNLVKNLPGGQQNSSWNFSEDTVISILNTINEVIAENLEAAKKLRETQGIEKLVLINKSGNRSEKEVRAAALVLQTIWGYKELRKPLEKEGWKKSDFQVNLNNASRSQSSHSYDDSTLPLIDRNQKSDNNYSTPNERGDHNRTLDRSGDLGDMEPLKGTTPLMQDEGQESLEEELDVLVLDDEGGQVSYPSMQKI

SEQ ID NO: 10588 - protein, 884 aa, Human
FLLPVLTSRSLRQPAVPHARLGGVEPAAMKSARAKTPRKPTVKKGSQTNLKDPVGVYCRVRPLGFPDQECCIEVINNTTVQLHTPEGYRLNRNGDYKETQYSFKQVFGTHTTQKELFDVVANPLVNDLIHGKNGLLFTYGVTGSGKTHTMTGSPGEGGLLPRCLDMIFNSIGSFQAKRYVFKSNDRNSMDIQCEVDALLERQKREAMPNPKTSSSKRQVDPEFADMITVQEFCKAEEVDEDSVYGVFVSYIEIYNNYIYDLLEEVPFDPIKPKPPQSKLLREDKNHNMYVAGCTEVEVKSTEEAFEVFWRGQKKRRIANTHLNRESSRSHSVFNIKLVQAPLDADGDNVLQEKEQITISQLSLVDLAGSERTNRTRAEGNRLREAGNINQSLMTLRTCMDVLRENQMYGTNKMVPYRDSKLTHLFKNYFDGEGKVRMIVCVNPKAEDYEENLQVMRFAEVTQEVEVARPVDKAICGLTPGRRYRNQPRGPVGNEPLVTDVVLQSFPPLPSCEILDINDEQTLPRLIEALEKRHNLRQMMIDEFNKQSNAFKALLQEFDNAVLSKENHMQGKLNEKEKMISGQKLEIERLEKKNKTLEYKIEILEKTTTIYEEDKRNLQQELETQNQKLQRQFSDKRRLEARLQGMVTETTMKWEKECERRVAAKQLEMQNKLWVKDEKLKQLKAIVTEPKTEKPERPSRERDREKVTQRSVSPSPVPLLFQPDQNAPPIRLRHRRSRSAGDRWVDHKPASNMQTETVMQPHVPHAITVSVANEKALAKCEKYMLTHQELASDGEIETKLIKGDIYKTRGGGQSVQFTDIETLKQESPNGSRKRRSSTVAPAQPDGAESEWTDVETRCSVAVEMRAGSQLGPGYQHHAQPKRKKP

SEQ ID NO: 10589 - protein, 360 aa, Human
GWVRGAGAGNWSLNSGGEMDILKSEILRKRQLVEDRNLLVENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIKFMLQREYVKANDAYLQMAIGNAPWPIGVTMVGIHARTGREKIFSKHVAHVLNDETQRKYIQGLKRLMTICQKHFPTDPSKCVEYNAL

SEQ ID NO: 10590 - protein, 536 aa, Human
ALARARRTRAGIASDPERSPGAMALSELALVRWLQESRRSRKLILFIVFLALLLDNMLLTVVVPIIPSYLYSIKHEKNATEIQTARPVHTASISDSFQSIFSYYDNSTMVTGNATRDLTLHQTATQHMVTNASAVPSDCPSEDKDLLNENVQVGLLFASKATVQLITNPFIGLLTNRIGYPIPIFAGFCIMFVSTIMFAFSSSYAFLLIARSLQGIGSSCSSVAGMGMLASVYTDDEERGNVMGIALGGLAMGVLVGPPFGSVLYEFVGKTAPFLVLAALVLLDGAIQLFVLQPSRVQPESQKGTPLTTLLKDPYILIAAGSICFANMGIAMLEPALPIWMMETMCSRKWQLGVAFLPASISYLIGTNIFGILAHKMGRWLCALLGMIIVGVSILCIPFAKNIYGLIAPNFGVGFAIGMVDSSMMPIMGYLVDLRHVSVYGSVYAIADVAFCMGYAIGPSAGGAIAKAIGFPWLMTIIGIIDILFAPLCFFLRSPPAKEEKMAILMDHNCPIKTKMYTQNNIQSYPIGEDEESESD

SEQ ID NO: 10591 - protein, 255 aa, Human [sequence omitted]

SEQ ID NO: 10592 - protein, 182 aa, Human
PSPPPPARAPSARTRRAPIPAAGQGRARPPRTVSRCGSAAMATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 10593 - protein, 687 aa, Human
TTTPAPEPAAVPAAEELCLPLHLTRARRPAACAPAQPASPPGARPVAALHARGEPSALAGTEGPAAVMLSAIYTVLAGLLFLPLLVNLCCPYFFQDIGYFLKVAAVGRRVRSYGQRRPARTILRAFLEKARQTPHKPFLLFRDETLTYAQVDRRSNQVARALHDHLGLRQGDCVALLMGNEPAYVWLWLGLVKLGCAMACLNYNIRAKSLLHCFQCCGAKVLLVSPELQAAVEEILPSLKKDDVSIYYVSRTSNTDGIDSFLDKVDEVSTEPIPESWRSEVTFSTPALYIYTSGTTGLPKAAMITHQRIWYGTGLTFVSGLKADDVIYITLPFYHSAALLIGIHGCIVAGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKENHEFDGKKLFQHIADYLPSYARPRFLRIQDTIEITGTFKHRKMTLVEEGFNPAVIKDALYFLDDTAKMYVPMTEDIYNAISAKTLKL

SEQ ID NO: 10594 - protein, 417 aa, Human
RDDELLSVHTFPEHIHTPCSGIPCEAALMEFPLAQICPQGSHEAPIPTFSTFQITDMTRRSCQNLGYTAASPQAPEAASSTGNAERAEEVPGEGSLFLQAETRAWFQKTQAHWLLQHGAAPAWFHGFITRREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 10595 - protein, 1248 aa, Human [sequence omitted]

SEQ ID NO: 10596 - protein, 1248 aa, Human [sequence omitted]

SEQ ID NO: 10597 - protein, 734 aa, Human
PPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 10598 - protein, 443 aa, Human
FLCGITMAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 10599 - protein, 94 aa, Human
SSTMKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 10600 - protein, 712 aa, Human
MGTTAPGPIHLLELCDQKLMEFLCNMDNKDLVWLEEIQEEAERMFTREFSKEPELMPKTPSQKNRRKKRRISYVQDENRDPIRRRLSRRKSRSSQLSSRRLRSKDSVEKLATVVGENGSVLRRVTRAAAAAAAATMALAAPSSPTPESPTMLTKKPEDNHTQCQLVPVVEIGISERQNAEQHVTQLMSTEPLPRTLSPTPASATAPTSQGIPTSDEESTPKKSKARILESITVSSLMATPQDPKGQGVGTGRSASKLRIAQVSPGPRDSPAFPDSPWRERVLAPILPDNFSTPTGSRTDSQSVRHSPIAPSSPSPQVLAQKYSLVAKQESVVRRASRRLAKKTAEEPAASGRIICHSYLERLLNVEVPQKVGSEQKEPPEEAEPVAAAEPEVPENNGNNSWPHNDTEIANSTPNPKPAASSPETPSAGQQEAKTDQADGPREPPQSARRKRSYKQAVSELDEEQHLEDEELQPPRSKTPSSPCPASKVVRPLRTFLHTVQRNQMLMTPTSAPRSVMKSFIKRNTPLRMDPKEKERQRLENLRRKEEAEQLRRQKVEEDKRRRLEEVKLKREERLRKVLQARERVEQMKEEKKKQIEQKFAQIDEKTEKAKEERLAEEKAKKKAAAKKMEEVEARRKQEEEARRLRWLQQEEEERRHQELLQKKKEEEQERLRKAAEAKRLAEQREQERREQERREQERREQERREQERREQE

SEQ ID NO: 10601 - protein, 512 aa, Human
APSEVKEHKMVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 10602 - protein, 408 aa, Human
LPDLQTSSPALSANLSDMSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 10603 - protein, 210 aa, Human
DAAHGGTRPAPMAFALLRPVGAHVLYPDVRLLSEDEENRSESDASDQSFGCCEGPEAARRGPGPGGGRRAGGGGGAGPVVVVRQRQAANARERDRTQSVNTAFTALRTLIPTEPVDRKLSKIETLRLASSYIAHLANVLLLGDSADDGQPCFRAAGSAKGAVPAAADGGRQPRSICTFCLSNQRKGGGRRDLGGSCLKVRGVAPLRGPRR

SEQ ID NO: 10604 - protein, 651 aa, Human
SQEMATAVEPEDQDLWEEEGILMVKLEDDFTCRPESVLQRDDPVLETSHQNFRRFRYQEAASPREALIRLRELCHQWLRPERRTKEQILELLVLEQFLTVLPGELQSWVRGQRPESGEEAVTLVEGLQKQPRRPRRWVTVHVHGQEVLSEETVHLGVEPESPNELQDPVQSSTPEQSPEETTQSPDLGAPAEQRPHQEEELQTLQESEVPVPEDPDLPAERSSGDSEMVALLTALSQGLVTFKDVAVCFSQDQWSDLDPTQKEFYGEYVLEEDCGIVVSLSFPIPRPDEISQVREEEPWVPDIQEPQETQEPEILSFTYTGDRSKDEEECLEQEDLSLEDIHRPVLGEPEIHQTPDWEIVFEDNPGRLNERRFGTNISQVNSFVNLRETTPVHPLLGRHHDCSVCGKSFTCNSHLVRHLRTHTGEKPYKCMECGKSYTRSSHLARHQKVHKMNAPYKYPLNRKNLEETSPVTQAERTPSVEKPYRCDDCGKHFRWTSDLVRHQRTHTGEKPFFCTICGKSFSQKSVLTTHQRIHLGGKPYLCGECGEDFSEHRRYLAHRKTHAAEELYLCSECGRCFTHSAAFAKHLRGHASVRPCRCNECGKSFSRRDHLVRHQRTHTGEKPFTCPTCGKSFSRGYHLIRHQRTHSEKTS

SEQ ID NO: 10605 - protein, 894 aa, Human
GKVFHEAVAPFRLAFSSLTLVPAPVRAPAVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQSTMSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 10606 - protein, 622 aa, Human
VGIHGRRASVRVSIPPGPLSARPLGAGPRAPVPVRQPRRSAAGPRAPEGAMSYQGKKSIPHITSDRLLIKGGRIINDDQSLYADVYLEDGLIKQIGENLIVPGGVKTIEANGRMVIPGGIDVNTYLQKPSQGMTAADDFFQGTRAALVGGTTMIIDHVVPEPGSSLLTSFEKWHEAADTKSCCDYSLHVDITSWYDGVREELEVLVQDKGVNSFQVYMAYKDVYQMSDSQLYEAFTFLKGLGAVILVHAENGDLIAQEQKRILEMGITGPEGHALSRPEELEAEAVFRAITIAGRINCPVYITKVMSKSAADIIALARKKGPLVFGEPIAASLGTDGTHYWSKNWAKAAAFVTSPPLSPDPTTPDYLTSLLACGDLQVTGSGHCPYSTAQKAVGKDNFTLIPEGVNGIEERMTVVWDKAVATGKMDENQFVAVTSTNAAKIFNLYPRKGRIAVGSDADVVIWDPDKLKTITAKSHKSAVEYNIFEGMECHGSPLVVISQGKIVFEDGNINVNKGMGRFIPRKAFPEHLYQRVKIRNKVFGLQGVSRGMYDGPVYEVPATPKYATPAPSAKSSPSKHQPPPIRNLHQSNFSLSGAQIDDNNPRRTGHRIVAPPGGRSNITSLG

SEQ ID NO: 10607 - protein, 200 aa, Human
KLDKMPGMFFSANPKELKGTTHSLLDDKMQKRRPKTFGMDMKAYLRSMIPHLESGMKSSKSKDVLSAAEVMQWSQSLEKLLANQTGQNVFGSFLKSEFSEENIEFWLACEDYKKTESDLLPCKAEEIYKAFVHSDAAKQINIDFRTRESTAKKIKAPTPTCFDEAQKVIYTLMEKDSYPRFLKSDIYLNLLNDLQANSLK

SEQ ID NO: 10608 - protein, 221 aa, Human
NSRGSSGRTIMQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 10609 - protein, 907 aa, Human
HKLLTEIGKVAGTPSFLLTFYGASVGIVGESTYNMSFIMKLHRHFQRTVILLATFCMVSIIISAYYLYSGYKQENELSETASEVDCGDLQHLPYQLMEVKAMKLFDASRTDPTVLVFVESQYSSLGQDIIMILESSRFQYHIEIAPGKGDLPVLIDKMKGKYILIIYENILKYINMDSWNRSLLDKYCVEYGVGVIGFHKTSEKSVQSFQLKGFPFSIYGNLAVKDCCINPHSPLIRVTKSSKLEKGSLPGTDWTVFQINHSAYQPVIFAKVKTPENLSPSISKGAFYATIIHDLGLHDGIQRVLFGNNLNFWLHKLIFIDAISFLSGKRLTLSLDRYILVDIDDIFVGKEGTRMNTNDVKALLDTQNLLRAQITNFTFNLGFSGKFYHTGTEEEDEGDDCLLGSVDEFWWFPHMWSHMQPHLFHNESSLVEQMILNKKFALEHGIPTDMGYAVAPHHSGVYPVHVQLYEAWKKVWNIKITSTEEYPHLKPARYRRGFIHKNIMVLPRQTCGLFTHTIFYKEYPGGPKELDKSIQGGELFFTVVLNPISIFMTHLSNYGNDRLGLYTFVNLANFVKSWTNLRLQTLPPVQLAHKYFELFPDQKDPLWQNPCDDKRHRDIWSKEKTCDRLPKFLVIGPQKTGTTALYLFLVMHPSILSNSPSPKTFEEVQFFNRNNYHRGIDWYMDFFPVPSNVTTDFLFEKSANYFHSEEAPKRAASLVPKAKIITILIDPSDRAYSWYQHQRSHEDPAALKFSFYEVISAGPRAPSELRALQKRCLVPGWYASHIERWLVYFPPFQLLIIDGQQLRTDPATVMDEVQKFLGVLPHYNYSEALTFDSHKGFWCQLLEEGKTKCLGKSKGRKYPPMDSDSRTFLSSYYRDHNVELSKLLHKLGQPLPSWLRQELQKVR

SEQ ID NO: 10610 - protein, 47 aa, Human
DLPTGEHASRKRSPSSLPRRREEETQEETPGAEPQFLLHGCEMPRII

SEQ ID NO: 10611 - protein, 248 aa, Human
LPPPTLAMFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 10612 - protein, 596 aa, Human
AASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 10613 - protein, 215 aa, Human
KAIMEISMPPPQIYVEKTLAIIKPDIVDKEEEIQDIILRSGFTIVQRRKLRLSPEQCSNFYVEKYGKMFFPNLTAYMSSGPLVAMILARHKAISYWLELLGPNNSLVAKETHPDSLRAIYGTDDLRNALHGSNDFAAAEREIRFMFPEVIVEPIPIGQAAKDYLNLHIMPTLLEGLTELCKQKPADPLIWLADWLLKNNPNKPKLCHHPIVEEPY

SEQ ID NO: 10614 - protein, 341 aa, Human
EKETSANDMLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSMNWIALVVIVPLVILIVLVLWFKKHCSYQDIL

SEQ ID NO: 10615 - protein, 340 aa, Human
EVASPSEMLLLPFQLLAVLFPGGNSEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGEQEQQGTQLGDILPNANWTWYLRATLDVADGEAAGLSCRVKHSSLEGQDIILYWRNPTSIGSIVLAIIVPSLLLLLCLALWYMRRRSYQNIP

SEQ ID NO: 10616 - protein, 240 aa, Human
MGLELYLDLLSQPCRAVYIFAKKNDIPFELRIVDLIKGQHLSDAFAQVNPLKKVPALKDGDFTLTESVAILLYLTRKYKVPDYWYPQDLQARARVDEYLAWQHTTLRRSCLRALWHKVMFPVFLGEPVSPQTLAATLAELDVTLQLLEDKFLQNKAFLTGPHISLADLVAITELMHPVGAGCQVFEGRPKLATWRQRVEAAVGEDLFQEAHEVILKAKDFPPADPTIKQKLMPWVLAMIR

SEQ ID NO: 10617 - protein, 259 aa, Human
PRTCAEHQTGRKGRQEDLADGGGQASRGSKGSRGPLASGQASKALKETRGNLGPLETPARWATQGPAAPSGPVASRELKAPRAAQETSRTSRGQPSPPFGGTPQWGATWSSSTRSSPTRKNRTRTTPADSSALYPATTTSPSRCCPSGKSACPSSPPQGARSDAPWASVTPPTRGSSRWCQGAWCFSCSRVTRSGLKKTPKRVTFTRALRPTASSAASSSSHLPEPGKDPLPHPPLWLPCSACKMGALLLQLLKGGGWL

SEQ ID NO: 10618 - protein, 199 aa, Human
SGYKTISAMQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 10619 - protein, 255 aa, Human
HSMMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 10620 - protein, 1005 aa, Human; identical to SEQ ID NO: 6968

SEQ ID NO: 10621 - protein, 404 aa, Human
RMACREGAGSRRARSNGCRLPRRGRRRGGRRRTVGPGPIHCRGRRALGPRVFRVMEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSEL

SEQ ID NO: 10622 - protein, 404 aa, Human; identical to SEQ ID NO: 10621

SEQ ID NO: 10623 - protein, 404 aa, Human; identical to SEQ ID NO: 10621

SEQ ID NO: 10624 - protein, 682 aa, Human
QTIEMWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGATTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 10625 - protein, 266 aa, Human
LRLLPGLSLTMLSRVVLSAAATAAPSLKNAAFLGPGVLQATRTFHTGQPHLVPVPPLPEYGGKVRYGLIPEEFFQFLYPKTGVTGPYVLGTGLILYALSKEIYVISAETFTALSVLGVMVYGIKKYGPFVADFADKLNEQKLAQLEEAKQASIQHIQNAIDTEKSQQALVQKRHYLFDVQRNNIAMALEVTYRERLYRVYKEVKNRLDYHISVQNMMRRKEQEHMINWVEKHVVQSISTQQEKETIAKCIADLKLLAKKAQAQPVM

SEQ ID NO: 10626 - protein, 231 aa, Human
GTVPGKGQEYHGMGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEGCYAKARLWFHSNFLYIGIITICVCVIEVLGMSFALTLNCQIDKTSQTIGL

SEQ ID NO: 10627 - protein, 1003 aa, Human
VWPGLTVYPDFTNPNCIDWWANECSIFHQEVQYDGLWIDMNEVSSFIQGSTKGCNVNKLNYPPFTPDILDKLMYSKTICMDAVQNWGKQYDVHSLYGYSMAIATEQAVQKVFPNKRSFILTRSTFAGSGRHAAHWLGDNTASWEQMEWSITGMLEFSLFGIPLVGADICGFVAETTEELCRRWMQLGAFYPFSRNHNSDGYEHQDPAFFGQNSLLVKSSRQYLTIRYTLLPFLYTLFYKAHVFGETVARPVLHEFYEDTNSWIEDTEFLWGPALLITPVLKQGADTVSAYIPDAIWYDYESGAKRPWRKQRVDMYLPADKIGLHLRGGYIIPIQEPDVTTTASRKNPLGLIVALGENNTAKGDFFWDDGETKDTIQNGNYILYTFSVSNNTLDIVCTHSSYQEGTTLAFQTVKILGLTDSVTEVRVAENNQPMNAHSNFTYDASNQVLLIADLKLNLGRNFSVQWNQIFSENERFNCYPDADLATEQKCTQRGCVWRTGSSLSKAPECYFPRQDNSYSVNSARYSSMGITADLQLNTANARIKLPSDPISTLRVEVKYHKNDMLQFKIYDPQKKRYEVPVPLNIPTTPISTYEDRLYDVEIKENPFGIQIRRRSSGRVIWDSWLPGFAFNDQFIQISTRLPSEYIYGFGEVEHTAFKRDLNWNTWGMFTRDQPPGYKLNSYGFHPYYMALEEEGNAHGVFLLNSNAMDVTFQPTPALTYRTVGGILDFYMFLGPTPEVATKQYHEVIGHPVMPAYWALGFQLCRYGYANTSEVRELYDAMVAANIPYDVQYTDIDYMERQLDFTIGEAFQDLPQFVDKIRGEGMRYIIILDPAISGNETKTYPAFERGQQNDVFVKWPNTNDICWAKVWPDLPNITIDKTLTEDEAVNASRAHVAFPDFFRTSTAEWWAREIVDFYNEKMKFDGLWIDMNEPSSFVNGTTTNQCRNDELNYPPYFPELTKRTDGLHFRTICMEAEQILSDGTSVLHYDVHNLYGWSQMKPTHE

SEQ ID NO: 10628 - protein, 326 aa, Human
QSWNTIPLCMKRLSLVTTNRLSPQGNFLPLCTFPLAVDMAALFQEASSCPVCSDYLEKPMSLECGCTVCLKCINSLQKEPHGEDLLCCCCSMVSQRNKIRPNRQLERLVSHIKELEPKLKKILQMNPRMRKFQVDMTLDADTANNFLLISDDLRSVRSGLITQNRQDLAERFDVSVCILGSPRFTCGRHYWEVDVGTSTEWDLGVCRESVHCKGKIQLTTELGFWTVSLRDGSRLSASTVPLTFLLVDRKLQRVGIFLDMGMQNVSFFDAESGSHVYTFRSVSAEEPLRPFLAPSIPPNGDQGVLSICPLMNSGTTDAPVRPGEAK

SEQ ID NO: 10629 - protein, 713 aa, Human
DTSALTMSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTRDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEEPLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 10630 - protein, 558 aa, Human
CAPGPSAPPARRRVPLAMGHSPPVLPLCASVSLLGGLTFGYELAVISGALLPLQLDFGLSCLEQEFLVGSLLLGALLASLVGGFLIDCYGRKQAILGSNLVLLAGSLTLGLAGSLAWLVLGRAVVGFAISLSSMACCIYVSELVGPRQRGVLVSLYEAGITVGILLSYALNYALAGTPWGWRHMFGWATAPAVLQSLSLLFLPAGTDETATHKDLIPLQGGEAPKLGPGRPRYSFLDLFRARDNMRGRTTVGLGLVLFQQLTGQPNVLCYASTIFSSVGFHGGSSAVLASVGLGAVKVAATLTAMGLVDRAGRRALLLAGCALMALSVSGIGLVSFAVPMDSGPSCLAVPNATGQTGLPGDSGLLQDSSLPPIPRTNEDQREPILSTAKKTKPHPRSGDPSAPPRLALSSALPGPPLPARGHALLRWTALLCLMVFVSAFSFGFGPVTWLVLSEIYPVEIRGRAFAFCNSFNWAANLFISLSFLDLIGTIGLSWTFLLYGLTAVLGLGFIYLFVPETKGQSLAEIDQQFQKRRFTLSFGHRQNSTGIPYSRIEISAAS

SEQ ID NO: 10631 - protein, 761 aa, Human
PVRRRRRRQRQRKMVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 10632 - protein, 313 aa, Human
GPQQVGIGRNRSPQRSPKMQPEGAEKGKSFKQRLVLKSSLAKETLSEFLGTFILIVLGCGCVAQAILSRGRFGGVITINVGFSMAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKTEQSEDKPEKYELSVIM

SEQ ID NO: 10633 - protein, 569 aa, Human
ALLQLSSALGRWRPGMRRPLSKCGMEPGGGDASLTLHGLQNRSHGKIKLRKRKSTLYFNTQEKSARRRGDLLGENIYLLLFTIALRILNCFLVQTSFVPDEYWQSLEVSHHMVFNYGYLTWEWTERLRSYTYPLIFASIYKILHLLGKDSVQLLIWIPRLAQALLSAVADVRLYSLMKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNWGTFYGSHPWHWYFSQGFPVILGTHLPFFIHGCYLAPKRYRILLVTVLWTLLVYSMLSHKEFRFIYPVLPFCMVFCGYSLTHLKTWKKPALSFLFLSNLFLALYTGLVHQRGTLDVMSHIQKVCYNNPNKSSASIFIMMPCHSTPYYSHVHCPLPMRFLQCPPDLTGKSHYLDEADVFYLNPLNWLHREFHDDASLPTHLITFSILEEEISAFLISSNYKRTAVFFHTHLPEGRIGSHIYVYERKLKGKFNMKMKF

SEQ ID NO: 10634 - protein, 272 aa, Human
GRGCVRSGQSRGRLRPLHPGPAAAHHPARRVLAVLHSGVRLHRERGLPQQRLRGGGVLHLQPQPQRLQLWRGRGRARLPHLPAVPGPGRVLPADQQRQGPQESRPVRHRCLGLLGFPLVRGILLPGQPVAGLQAQGQPTERRDGRSPGRHRLLLFLHLHLGGPGCAGLPAVPDWRRLGPLLPGLHGPQPGLQHALRALRGAHWAGSRRYGRHLPAAGQHLRHRAPGLPVAGLLSHSDRLPPPLPICPLSPHPAPAPAQAALPSASSASALSH

SEQ ID NO: 10635 - protein, 484 aa, Human
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 10636 - protein, 256 aa, Human
GARRGRAASDMGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 10637 - protein, 338 aa, Human
LPSSTCGVGDAHRKRPPDRVSEGAGEPEGWSLFAPRLRHQGLGAGPSCNLCGSNMAPRLCSISVTARRLLGGPGPRAGDVASAAAARFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKYRQENQEAVGGFFSQIGELYVVHHLWAYKDLQSREETRNAAWRKRGWDENVYYTVPLVRHMESRIMIPLKISPLQ

SEQ ID NO: 10638 - protein, 188 aa, Human
TDHIMREYKLVVLGSGGVGKSALTVQFVQGIFVEKYDPTIEDSYRKQVEVDCQQCMLEILDTAGTEQFTAMRDLYMKNGQGFALVYSITAQSTFNDLQDLREQILRVKDTEDVPMILVGNKCDLEDERVVGKEQGQNLARQWCNCAFLESSAKSKINVNEIFYDLVRQINRKTPVEKKKPKKKSCLLL

SEQ ID NO: 10639 - protein, 397 aa, Human
GSLRGAMLRPGGAEEAAQLPLRRASAPVPVPSPAAPDGSRASARLGLACLLLLLLLTLPARVDTSWWYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 10640 - protein, 397 aa, Human; identical to SEQ ID NO: 10639

SEQ ID NO: 10641 - protein, 1343 aa, Human
LAGGAPRRAGCHALLIPLCPPPSMFGLDQFEPQVNSRNAGQGERNFNETGLSMNTHFKAPAFHTGGPPGPVDPAMSALGEPPILGMNMEPYGFHARGHSELHAGGLQAQPVHGFFGGQQPHHGHPGSHHPHQHHPHFGGNFGGPDPGASCLHGGRLLGYGGAAGGLGSQPPFAEGYEHMAESQGPESFGPQRPGNLPDFHSSGASSHAVPAPCLPLDQSPNRAASFHGLPSSSGSDSHSLEPRRVTNQGAVDSLEYNYPGEAPSGHFDMFSPSDSEGQLPHYAAGRQVPGGAFPGASAMPRAAGMVGLSKMHAQPPQQQPQQQQQPQQQQQQHGVFFERFSGARKMPVGLEPSVGSRHPLMQPPQQAPPPPQQQPPQQPPQQQPPPPPGLLVRQNSCPPALPRPQQGEAGTPSGGLQDGGPMLPSQHAQFEYPIHRLENRSMHPYSEPVFSMQHPPPQQAPNQRLQHFDAPPYMNVAKRPRFDFPGSAGVDRCASWNGSMHNGALDNHLSPSAYPGLPGEFTPPVPDSFPSGPPLQHPAPDHQSLQQQQQQQQQQQQQQQQQQQQQQQQQQQQRQNAALMIKQMASRNQQQRLRQPNLAQLGHPGDVGQGGLVHGGPVGGLAQPNFEREGGSTGAGRLGTFEQQAPHLAQESAWFSGPHPPPGDLLPRRMGGSGLPADCGPHDPSLAPPPPPGGSGVLFRGPLQEPMRMPGEGHVPALPSPGLQFGGSLGGLGQLQSPGAGVGLPSAASERRPPPPDFATSALGGQPGFPFGAAGRQSTPHSGPGVNSPPSAGGGGGSSGGGGGGGAYPPQPDFQPSQRTSASKLGALSLGSFNKPSSKDNLFGQSCLAALSTACQNMIASLGAPNLNVTFNKKNPPEGKRKLSQNETDGAAVAGNPGSDYFPGGTAPGAPGPGGPSGTSSSGSKASGPPNPPAQGDGTSLSPNYTLESTSGNDGKPVSGGGGRGRGRRKRDSGHVSPGTFFDKYSAAPDSGGAPGVSPGQQQASGAAVGGSSAGETRGAPTPHEKALTSPSWGKGAELLLGDQPDLIGSLDGGAKSDSSSPNVGEFASDEVSTSYANEDEVSSSSDNPQALVKASRSPLVTGSPKLPPRGVGAGEHGPKAPPPALGLGIMSNSTSTPDSYGGGGGPGHPGTPGLEQVRTPTSSSGAPPPDEIHPLEILQAQIQLQRQQFSISEDQPLGLKGGKKGECAVGASGAQNGDSELGSCCSEAVKSAMSTIDLDSLMAEHSAAWYMPADKALVDSADDDKTLAPWEKAKPQNPNSKEAHDLPANKASASQPGSHLQCLSVHCTDDVGDAKARASVPTWRSLHSDISNRFGTFVAALT

SEQ ID NO: 10642 - protein, 122 aa, Human
GQPPPQRAVAGGGGLHPLAAALREAGHLPEPAQRAAGCGGGPLAAPAHVGVMVPPATAGECVPESCGLNPDFHSEQVVFCVGLFFIFDDLQMEGENRVSTRHYLKGQITQQISHVGSTILCF

SEQ ID NO: 10643 - protein, 1651 aa, Human
ARRKRCRSAQGLLPPPPLHRLPERACRAPPSPLSFLGELRGWGGRGSPSARRNRRRRRPRFRCRAPEPPSPPRALPGGGPPSPMEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 10644 - protein, 698 aa, Human
PPPPPPKLANMADLEAVLADVSYLMAMEKSKATPAARASKRIVLPEPSIRSVMQKYLAERNEITFDKIFNQKIGFLLFKDFCLNEINEAVPQVKFYEEIKEYEKLDNEEDRLCRSRQIYDAYIMKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRGHSPFRQHKTKDKHEIDRMTLTVNVELPDTFSPELKSLLEGLLQRDVSKRLGCHGGGSQEVKEHSFFKGVDWQHVYLQKYPPPLIPPRGEVNAADAFDIGSFDEEDTKGIKLLDCDQELYKNFPLVISERWQQEVTETVYEAVNADTDKIEARKRAKNKQLGHEEDYALGKDCIMHGYMLKLGNPFLTQWQRRYFYLFPNRLEWRGEGESRQNLLTMEQILSVEETQIKDKKCILFRIKGGKQFVLQCESDPEFVQWKKELNETFKEAQRLLRRAPKFLNKPRSGTVELPKPSLCHRNSNGL

SEQ ID NO: 10645 - protein, 413 aa, Human
GGFGLLGFLSALLALVLRARAGSQTPQTLLLPAAAFRRGETPRFKMSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNHNGNIFAYASSYDWSKGHEFYNPQKKNYIFLRNAAEELKPRNKK

SEQ ID NO: 10646 - protein, 409 aa, Human
DRGFWSFWQPSALMAFAPMGPEASFFDVLDRHRESLLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 10647 - protein, 472 aa, Human
GRSGARLQQVTERRGRPPAPSATWGGAGPEPGARVARRAGAMHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 10648 - protein, 553 aa, Human
RDKGGAGQHGDSAPSGGSAGAAALSLTYPAFGFRDRLAAVNAELGRRGARFLGLGVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLHFAVAGRLGGSGRLCMEASES

SEQ ID NO: 10649 - protein, 479 aa, Human
LRRRAHCPSCWFSTLVLAPGVCKMKIEEVKSTTKTQRIASHSHVKGLGLDESGLAKQAASGLVGQENAREACGVIVELIKSKKMAGRAVLLAGPPGTGKTALALAIAQELGSKVPFCPMVGSEVYSTEIKKTEVLMENFRRAIGLRIKETKEVYEGEVTELTPCETENPMGGYGKTISHVIIGLKTAKGTKQLKLDPSIFESLQKERVEAGDVIYIEANSGAVKRQGRCDTYATEFDLEAEEYVPLPKGDVHKKKEIIQDVTLHDLDVANARPQGGQDILSMMGQLMKPKKTEITDKLRGEINKVVNKYIDQGIAELVPGVLFVDEVHMLDIECFTYLHRALESSIAPIVIFASNRGNCVIRGTEDITSPHGIPLDLLDRVMIIRTMLYTPQEMKQIIKIRAQTEGINISEEALNHLGEIGTKTTLRYSVQLLTPANLLAKINGKDSIEKEHVEEISELFYDAKSSAKILADQQDKYMK

SEQ ID NO: 10650 - protein, 391 aa, Human
GSFQRCKKGQRLFPMAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 10651 - protein, 264 aa, Human
PGDMAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 10652 - protein, 382 aa, Human
MCRLKKSSRGEDCVPPASRWHHTRLVRSAGEFWPFRRAVGLLPHQCARRRVFIAAREMSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKGFLNSSELSGLPAGPDREGSLKDQLALAIGKLGENMILKRAAWVKVPSGFYVGSYVHGAMQSPSLHKLVLGKYGALVICETSEQKTNLEDVGRRLGQHVVGMAPLSVGSLDDEPGGEAETKMLSQPYLLDPSITLGQYVQPQGVSVVDFVRFECGEGEEAAETE

SEQ ID NO: 10653 - protein, 520 aa, Human
PAAMLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 10654 - protein, 292 aa, Human
GLRLHVDLVEKPRTGIMAAETRNVAGAEAPPPQKRYYRQRAHSNPMADHTLRYPVKPEEMDWSELYPEFFAPLTQNQSHDDPKDKKEKRAQAQVEFADIGCGYGGLLVELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 10655 - protein, 292 aa, Human; identical to SEQ ID NO: 10654

SEQ ID NO: 10656 - protein, 276 aa, Human
PGPAPWSLQSPGKLCLSGSGTDHILSAISEVHSSQPSSRMALPPSPLAMEYVNDFDLMKFEVKREPSEGRPGPPTASLGSTPYSSVPPSPTFSEPGMVGATEGTRPGLEELYWLATLQQQLGAGEALGLSPEEAMELLQGQGPVPVDGPHGYYPGSPEETGAQHVQLAERFSDAALVSMSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 10657 - protein, 95 aa, Human
EQQFIRVQPQTGKKMLIKVKTLTGKEIEIDIEPTDKVERIKERVEEKEGIPPQQQRLIYSGKQMNDEKTAADYKILGGSVLHLVLALRGGGGLRQ

SEQ ID NO: 10658 - protein, 282 aa, Human
QRCDRLQKVDCVVGGPEQAEGKHDGAHQPAHPRPVPPGAPAGAPQPCQRHAVAAEHQPERKHESGQSLQAQVGGGVDRRRVAQLAYAVPPQVAVDGGRDGEQQGGQPDRQQQAAGQGRAAQPRRQEGAGDCEAALQAEQAGEQHAGVHAERAHVVHRLAARLAQRPGLPGQEGHKERREQQHRAVGQRQVQHKRGRQRSPPCRPPARQAPHHEAVARQPQQRRQQQEGCACGPRSLPAQQCLVPWGTVADRHPSGPTGHRKKVGKLGDPTRILGRKAGIVFI

SEQ ID NO: 10659 - protein, 282 aa, Human; identical to SEQ ID NO: 10658

SEQ ID NO: 10660 - protein, 555 aa, Human
PLHRQTPSPLCERTKPQKSLHLLRLAISRGPLAPSSLMSCVKLWPSGAPAPLVSIEELENQELVGKGGFGTVFRAQHRKWGYDVAVKIVNSKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLLDPELHVKLADFGLSTFQGGSQSGTGSGEPGGTLGYLAPELFVNVNRKASTASDVYSFGILMWAVLAGREVELPTEPSLVYEAVCNRQNRPSLAELPQAGPETPGLEGLKELMQLCWSSEPKDRPSFQECLPKTDEVFQMVENNMNAAVSTVKDFLSQLRSSNRRFSIPESGQGGTEMDGFRRTIENQHSRNDVMVSEWLNKLNLEEPPSSVPKKCPSLTKRSRAQEEQVPQAWTAGTSSDSMAQPPQTPETSTFRNQMPSPTSTGTPSPGPRGNQGAERQGMNWSCRTPEPNPVTGRPLVNIYNCSGVQVGDNNYLTMQQTTALPTWGLAPSGKGRGLQHPPPVGSQEGPKDPEAWSRPQGWYNHSGK

SEQ ID NO: 10661 - protein, 258 aa, Human
SSSNQGSLPEKMQPILLLLAFLLLPRADAGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 10662 - protein, 257 aa, Human
GKMQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 10663 - protein, 522 aa, Human
GSFCSRTGREAHMGQGPRSPHKVGRRFPAGGKRGRGAKGSGRPLPGRKRQPWPPPDGRSEPAPDSHPHLSPEALGYFRRALSALKEAPETGEERDLMVHNIMKEVETQALALSTNRTGKAQKTPAQECKPADFEVPETFLNRLQDLSSSFLKDIAVFITDKISSFCLQVALQVLHRKLPQFCAHLCNAVIGYLSTRGSSVDGSPLLLFLRDQTSSRLLEQVLLVLEPPRLQSLFEEHLQGQLQTLAAHPIANFPLQRLLDAVTTPELLSPVFEELSPVLEAVLAQGHPGVVIALVGACRRVGAYQAKVLQLLLEAFHCAEPSSRQVACVPLFATLMAYEVYYGLTEEEGAVPAEHQVAMAAARALGDVTVLGSLLLQHLLHFSTPGLVLRSLGALTGPQLLSLAQSPAGSHVLDAILTSPSVTRKLRRRVLQNLKGQYVALACSRHGSRVLDAIWSGAALRARKEIAAELGEQNQELIRDPFGHHVARNVALTTFLKRREAWEQQQGAVAKRRRALNSILED

SEQ ID NO: 10664 - protein, 816 aa, Human
MDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYEYDELIVRRGQPFHMLLLLSRTYESSDRITLELLIGNNPEVGKGTHVIIPVGKGGSGGWKAQVVKASGQNLNLRVHTSPNAIIGKFQFTVRTQSDAGEFQLPFDPRNEIYILFNPWCPEDIVYVDHEDWRQEYVLNESGRIYYGTEAQIGERTWNYGQFDHGVLDACLYILDRRGMPYGGRGDPVNVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVGDIGGNETVTLRQSFVPVRPGPRQLIASLDSPQLSQVHGVIQVDVAPAPGDGGFFSDAGGDSHLGETIPMASRGGA

SEQ ID NO: 10665 - protein, 769 aa, Human
PDLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 10666 - protein, 282 aa, Human
HTPEGRTRVPVVIAGVVYCQEALRDWGRVTASSTGAMAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQVKLKTVKENWKNLSDSEKELYIQHAKEDETRYHNEMKSWEEQMIEVGRKDLLRRTIKKQRKYGAEEC

SEQ ID NO: 10667 - protein, 176 aa, Human
LGRQCWVLSTMAPKKAKKRAGGANSNVFSMFEQTQIQEFKEAFTIMDQNRDGFIDKNDLRDTFAALGRVNVKNEEIDEMIKEAPGPINFTVFLTMFGEKLKGADPEETILNAFKVFDPEGKGVLKADYVREMLTTQAERFSKEEVDQMFAAFPPDVTGNLDYKNLVHIITHGEEKD

SEQ ID NO: 10668 - protein, 632 aa, Human
GGGNCIEVVAALPAPGRSASRLAFQPRLSPPGPAPASACPMSVSLVVIRLELAEHSPVPAGFGFSAAAGEMSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 10669 - protein, 171 aa, Human
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 10670 - protein, 254 aa, Human
IYILKSLQILTEESKLCETQYLPIRMVMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPQPEVQPGPALPALPVP

SEQ ID NO: 10671 - protein, 219 aa, Human
PPSPGAQPLPTATMAEDADMRNELEEMQRRADQLADESLESTRRMLQLVEESKDAGIRTLVMLDEQGEQLERIEEGMDQINKDMKEAEKNLTDLGKFCGLCVCPCNKLKSSDAYKKAWGNNQDGVVASQPARVVDEREQMAISGGFIRRVTNDARENEMDENLEQVSGIIGNLRHMALDMGNEIDTQNRQIDRIMEKADSNKTRIDEANQRATKMLGSG

SEQ ID NO: 10672 - protein, 570 aa, Human
MSRLEAKKPSLCKSEPLTTERVRTTLSVLKRIVTSCYGPSGRLKQLHNGFGGYVCTTSQSSALLSHLLVTHPILKILTASIQNHVSSFSDCGLFTAILCCNLIENVQRLGLTPTTVIRLNKHLLSLCISYLKSETCGCRIPVDFSSTQILLCLVRSILTSKPACMLTRKETEHVSALILRAFLLTIPENAEGHIILGKSLIVPLKGQRVIDSTVLPGILIEMSEVQLMRLLPIKKSTALKVALFCTTLSGDTSDTGEGTVVVSYGVSLENAVLDQLLNLGRQLISDHVDLVLCQKVIHPSLKQFLNMHRIIAIDRIGVTLMEPLTKMTGTQPIGSLGSICPNSYGSVKDVCTAKFGSKHFFHLIPNEATICSLLLCNRNDTAWDELKLTCQTALHVLQLTLKEPWALLGGGCTETHLAAYIRHKTHNDPESILKDDECTQTELQLIAEAFCSALESVVGSLEHDGGEILTDMKYGHLWSVQADSPCVANWPDLLSQCGCGLYNSQEELNWSFLRSTRRPFVPQSCLPHEAVGSASNLTLDCLTAKLSGLQVAVETANLILDLSYVIEDKN

SEQ ID NO: 10673 - protein, 299 aa, Human
LTMEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEAITLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 10674 - protein, 229 aa, Human
CLSAESAPTSTMPMTLGYWDIRGLAHAIRLLLEYTDSSYVEKKYTLGDAPDYDRSQWLNEKFKLGLDFPNLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEGLKKISAYMKSSQFLRGLLFGKSATWNSK

SEQ ID NO: 10675 - protein, 760 aa, Human
MLTFLPSPQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 10676 - protein, 343 aa, Human
MDPEHCAPFRVGPAPGPYVASGDEPPGPQGTPAAAPHLHPAPPRGPRLTRFPACGPLEPYLPEPAKPPAKYLQDLGPGPALNGGHFYEGPAEAEEKTSKAASFPQLPLDCRGGPRDGPSNLQGSPGPCLASLHLPLSPGLPDSMELAKNKSKKRRNRTTFSTFQLEELEKVFQKTHYPDVYAREQLALRTDLTEARVQVWFQNRRAKWRKRERYGKIQEGRNPFTAAYDISVLPRTDSHPQLQNSLWASPGSGSPGGPCLVSPEGIPSPCMSPYSHPHGSVAGFMGVPAPSAAHPGIYSIHGFPPTLGGHSFEPSSDGDYKSPSLVSLRVKPKEPPGLLNWTT

SEQ ID NO: 10677 - protein, 492 aa, Human
NRRGIMLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 10678 - protein, 295 aa, Human
VRARVPSPAAAMGCTLSAEDKAAVERSKMIDRNLREDGEKAAKEVKLLLLGAGESGKSTIVKQMKIIHEDGYSEDECKQYKVVVYSNTIQSIIAIIRAMGRLKIDFGEAARAQDVLRTRVKTTGIVETHFTFKDLYFKMFDVGGQRSERKKWIHCFEGVTAIIFCVALSDYDLVLAEDEEMNRMHESMKLFDSICNNKWFTETSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 10679 - protein, 346 aa, Human
GGGKRRAKRKSGRRRGSGEGGRGGGGRGEHKGSRSPDGRLIPRTMCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 10680 - protein, 163 aa, Human
RQAFEADRNGAWRPPRARVLAQAGGSASAEESRKRGREKRARTSARAPSSAAEELQPPTGRCGPCHAICSAQRLKVPASQLCQEAKVVTSSQARPARSAACKFCRGLRHANQSRRHGLRHEAGPWRGHKGHGEDAGGRGGEGPRRAEKGGGAAGGAAAAGGGA

SEQ ID NO: 10681 - protein, 200 aa, Human
NGGGFFNSKSAQFFSFQKKLMRSEKREKKPAPSLRGNRSSNCFSEKSSKGGSEGKKQKRGRHASACRGERSRDRRSRGGSATKETVTGSGAAKEEAVLPGSAPGHSWLAAALSAAKGHRPGTARGGKVAPGAEAAERSPRRRPDWLPRNCGDSPYSELGLRFPGLSPSPEAPTKPGKEGKDSGGSSSMSAYSRKPERARS

SEQ ID NO: 10682 - protein, 741 aa, Human
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRWAQFFIHPLMIRDAIDREVEAVDSGNAETLKHEPRKNNIDTHARLREFWMRYYSSHYMTLVVQSKVVPIRKIHALTITWALPPQQQHYRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEMIGIKCEGMPESFIIVLVWKIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 10683 - protein, 926 aa, Human
PRLRPLPPPPPRPEPQSARLPSPPLHDGNTMAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 10684 - protein, 165 aa, Human
PHCGPLLCTMSGGLLKALRSDSYVELSQYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 10685 - protein, 144 aa, Human
QEAQTELPQARISCPEGTNAYRSYCYYFNEDRETWVDADLYCQNMNSGNLVSVLTQAEGAFVASLIKESGTDDFNVWIGLHDPKKNRRWHWSSGSLVSYKSWGIGAPSSVNPGYCVSLTSSTGFQKWKDVPCEDKFSFVCKFKN

SEQ ID NO: 10686 - protein, 174 aa, Human
ARDSLPLSMAQTNSFFMLISSLMFLSLSQGQESQTELPNPRISCPEGTNAYRSYCYYFNEDPETWVDADLYCQNMNSGNLVSVLTQAEGAFVASLIKESSTDDSNVWIGLHDPKKNRRWHWSSGSLVSYKSWDTGSPSSANAGYCASLTSCSGFKKWKDESCEKKFSFVCKFKN

SEQ ID NO: 10687 - protein, 1058 aa, Human
SYSLVTMKLVNIWLLLLVVLLCGKKHLGDRLEKKSFEKAPCPGCSHLTLKVEFSSTVVEYEYIVAFNGYFTAKARNSFISSALKSSEVDNWRIIPRNNPSSDYPSDFEVIQIKEKQKAGLLTLEDHPNIKRVTPQRKVFRSLKYAESDPTVPCNETRWSQKWQSSRPLRRASLSLGSGFWHATGRHSSRRLLRAIPRQVAQTLQADVLWQMGYTGANVRVAVFDTGLSEKHPHFKNVKERTNWTNERTLDDGLGHGTFVAGVIASMRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRMKPDIVTYGAGVRGSGVKGGCRALSGTSVASPVVAGAVTLLVSTVQKRELVNPASMKQALIASARRLPGVNMFEQGHGKLDLLRAYQILNSYKPQASLSPSYIDLTECPYMWPYCSQPIYYGGMPTVVNVTILNGMGVTGRIVDKPDWQPYLPQNGDNIEVAFSYSSVLWPWSGYLAISISVTKKAASWEGIAQGHVMITVASPAETESKNGAEQTSTVKLPIKVKIIPTPPRSKRVLWDQYHNLRYPPGYFPRDNLRMKNDPLDWNGDHIHTNFRDMYQHLRSMGYFVEVLGAPFTCFDASQYGTLLMVDSEEEYFPEEIAKLRRDVDNGLSLVIFSDWYNTSVMRKVKFYDENTRQWWMPDTGGANIPALNELLSVWNMGFSDGLYEGEFTLANHDMYYASGCSIAKFPEDGVVITQTFKDQGLEVLKQETAVVENVPILGLYQIPAEGGGRIVLYGDSNCLDDSHRQKDCFWLLDALLQYTSYGVTPPSLSHSGNRQRPPSGAGSVTPERMEGNHLHRYSKVLEAHLGDPKPRPLPACPRLSWAKPQPLNETAPSNLWKHQKLLSIDLDKVVLPNFRSNRPQVRPLSPGESGAWDIPGGIMPGRYNQEVGQTIPVFAFLGAMVVLAFFVVQINKAKSRPKRRKPRVKRPQLMQQVHPPKTPSV

SEQ ID NO: 10688 - protein, 86 aa, Human
DITAKLGIGEMAETDPKTVQDLTSVVQTLLQQMQDKFQTMSDQIIGTLDDMSSRIDDLEKNIADLMTQAGVEELESENKIPATQKS

SEQ ID NO: 10689 - protein, 485 aa, Human
TARRLLPLRLPPRPPGPRLASGQAAGALERAMDELLRRAVPPTPAYELREKTPAPAEGQCADFVSFYGGLAETAQRAELLGRLARGFGVDHGQVAEQSAGVLHLRQQQREAAVLLQAEDRLRYALVPRYRGLFHHISKLDGGVRFLVQLRADLLEAQALKLVEGPDVREMNGVLKGMLSEWFSSGFLNLERVTWHSPCEVLQKISEAEAVHPVKNWMDMKRRVGPYRRCYFFSHCSTPGEPLVVLHVALTGDISSNIQAIVKEHPPSETEEKNKITAAIFYSISLTQQGLQGVELGTFLIKRVVKELQREFPHLGVFSSLSPIPGFTKWLLGLLNSQTKEHGRNELFTDSECKEISEITGGPINETLKLLLSSSEWVQSEKLVRALQTPLMRLCAWYLYGEKHRGYALNPVANFHLQNGAVLWRINWMADVSLRGITGSCGLMANYRYFLEETGPNSTSYLGSKIIKASEQVLSLVAQFQKNSKL

SEQ ID NO: 10690 - protein, 423 aa, Human
GVGELLRLRRGGAAAGEAAAAAGFPGAMLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 10691 - protein, 375 aa, Human
KAGTSGKMAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 10692 - protein, 779 aa, Human
SALVVISASFSFFFLFCFAFSPLLNYVLLLNNNKKTTKHSSCGLVPGWSPAPRLEWMSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 10693 - protein, 779 aa, Human; identical to SEQ ID NO: 10692

SEQ ID NO: 10694 - protein, 741 aa, Human
PGHGAEGPPRGKMNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 10695 - protein, 253 aa, Human
EKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 10696 - protein, 215 aa, Human
GPMRPGTGQGGLEAPGEPGPNLRQRWPLLLLGLAVVTHGLLRPTAASQSRALGPGAPGGSSRSSLRSRWGRFLLQRGSWTGPRCWPRGFQSKHNSVTHVFGSGTQLTVLSQPKTTPSVTLFLPSSEEPQANKATLVCLMNDFYPGILMVTWKADGTLITQSVEMTTPSKQSNNKYVASSYLSLTPEQWRSRRSYSCQVMQEGSTVEKSVAPAECS

SEQ ID NO: 10697 - protein, 347 aa, Human
SLPRWLGSDSCSDPSPLPGMMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITSVAKALGVKTVGAQALKLFQEHPIFSEVISDQEAVAAIEKFVDDEKILVEPACGAALAAVYSHVIQKLQLEGNLRTPLPSLVVIVCGGSNISLAQLRALKEQLGMTNRLPK

SEQ ID NO: 10698 - protein, 733 aa, Human
GSQLRAMGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLCIFWKVNYNFEDETVRKFLLSQLQKTRPVILDPAEPTGDVGGGDRWCWHLLAKEAKEWLSSPCFKDGTGNPIPPWKVPTMQTPGSCGARIHPIVNEMFSSRSHRILNNNSKRNFWRSSGNRF

SEQ ID NO: 10699 - protein, 733 aa, Human; identical to SEQ ID NO: 10698

SEQ ID NO: 10700 - protein, 693 aa, Human
GSQLRAMGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLCIFWKVNYNFEDETVRKFLLSQLQKTRPVILDPAEPTGDVGGGDRWCWHLLAKEAKEWLSSPCFKDGTGNPIPPWKVPVKVI

SEQ ID NO: 10701 - protein, 693 aa, Human; identical to SEQ ID NO: 10700

SEQ ID NO: 10702 - protein, 446 aa, Human
VLVRTRLALQLLRQEAKGSGGPGRPEGQGPKGRARRPKPPGRGAMMVHCAGCERPILDRFLLNVLDRAWHIKCVQCCECKTNLSEKCFSREGKLYCKNDFFRRFGTKCAGCAQGISPSDLVRKARSKVFHLNCFTCMVCNKQLSTGEELYVIDENKFVCKDDYLSSSSLKEGSLNSVSSCTDRSLSPDLQDALQDDPKETDNSTSSDKETANNENEEQNSGTKRRGPRTTIKAKQLETLKAAFAATPKPTRHIREQLAQETGLNMRVIQVWFQNRRSKERRMKQLSALGARRHAFFRSPRRMRPLGGRLDESEMLGSTPYTYYGDYQGDYYAPGSNYDFFAHGPPSQAQSPADSSFLAASGPGSTPLGALEPPLAGPHAADNPRFTDMISHPDTPSPEPGLPGTLHPMPGEVFSGGPSPPFPMSGTSGYSGPLSHPNPELNEAAVW

SEQ ID NO: 10703 - protein, 2418 aa, Human
GINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIAAVPATAMPFRGYAVLGGERGGPEVQQVPAGERPLWFICSGMGTQWRGMGLSLMRLDRFRDSILRSDEAVKPFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPGVVPACHNSKDTVTISGPQAPVFEFVEQLRKEGVFAKEVRTGGMAFHSYFMEAIAPPLLQELKKVIREPKPRSARWLSTSIPKAQWHSSLARTSSAEYNVNNLVSPVLFQEALWHVPEHAVVLEIAPHARPQAVLKRGLKPSCTIIPLMKKDHRDNLEFFLAGIGRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARALGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 10704 - protein, 215 aa, Human
QEQDQVFHTRDQAKTRLPLPLLGPHCPQKAAAVIMGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 10705 - protein, 427 aa, Human
FWRIPITGGFKEANGFLAAKRTPMCKARNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 10706 - protein, 139 aa, Human
QQKGVLYLRDNRLHFPECLPHLHQEKYTPSPSTPADTTRQRERALDSSRDSHLETLGACPGRNGGGLALQEATPRDPGRRWPPQRPPFAPRRWEKIWAHGAPWAVQDNISSLAGKSLLRVRGCWGTRGLGKQGNKSSVC

SEQ ID NO: 10707 - protein, 139 aa, Human; identical to SEQ ID NO: 10706

SEQ ID NO: 10708 - protein, 638 aa, Human
LAGSLARPAHAPPPSVGSAVGCAAWSGSRSGRAAGAGGWERGAQDLPARERPLPPGEACAAMAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQLRKGPPVPPPPKHTPSKEVKQEQILSLFEDTFVPEISVTTPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 10709 - protein, 344 aa, Human
RWSSSRGPATRGASTSLRTALPPAAEPSLLAMSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 10710 - protein, 665 aa, Human
HRAMRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNINLIIILTFILVSAILLTTLAACCCVRRQKFNQQYKA

SEQ ID NO: 10711 - protein, 267 aa, Human
IFKMTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 10712 - protein, 268 aa, Human
CGTAATMRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLTEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 10713 - protein, 206 aa, Human
LNLVGWAFEPSKPTCKRLKPSHAWRGPSDTDVLSHHFRLSLHPQPHEQSPLPPWDSASVTVSFTPAWLALVRVPPGLCLYSIFLHPLPSVPSAKCFGPVLPAAAQRPWPRPRALSAAGFQETLSSAELVAWHPPVARGEGVPCCFCVCFLSLVGEVMSWMGRGGQGSFPRLFWVHRSPTADDELSLTGLDHELVLNCRGLKAAPKP

SEQ ID NO: 10714 - protein, 529 aa, Human
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYVVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 10715 - protein, 333 aa, Human
LRQWLLAQQLHAPWLRISSSLQRSPSRSAPEMTQPFNYSAFERIIFAGTSAAMSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRQV

SEQ ID NO: 10716 - protein, 477 aa, Human
PPQPYDFRLPRRLGNRRLPAAQRWAELKWLRRESRRHLKKLNHCSEAFFSLFQAVIKEQLQETQGLCEYAIYVQALIFRLEGNIQESLELFQTCAVLSPQSADNLKQVARSLFLLGKHKAAIEVYNEAAKLNQKDWAQDQLHNALNLNRHDLTYIMLGKIHLLEGDLDKAIEVYKKAVEFSPENTELLTTLGLLYLQLGIYQKAFEHLGNALTYDPTNYKAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDIENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKP

SEQ ID NO: 10717 - protein, 355 aa, Human
ASRVVSRAAVHCALRSPPPEARALAMSRPPPPRVASVLGTMEMGRRMDAPASAAAVRAFLERGHTELDTAFMYSDGQSETILGGLGLGLGGGDCRVKIATKANPWDGKSLKPDSVRSQLETSLKRLQCPQVDLFYLHAPDHGTPVEETLHACQRLHQEGKFVELGLSNYASWEVAEICTLCKSNGWILPTVYQGMYNATTRQVETELFPCLRHFGLRFYAYNPLAGGLLTGKYKYEDKDGKQPVGRFFGNSWAETYRNRFWKEHHFEAIALVEKALQAAYGASAPSVTSAALRWMYHHSQLQGAHGDAVILGMSSLEQLEQNLAATEEGPLEPAVVDAFNQAWHLVAHECPNYFR

SEQ ID NO: 10718 - protein, 420 aa, Human
ERGRGWRGGTRAASRSAEPGSRTMEEDDSYVPSDLTAEERQELENIRRRKQELLADIQRLKDEIAEVANEIENLGSTEERKNMQRNKQVAMGRKKFNMDPKKGIQFLIENDLLKNTCEDIAQFLYKGEGLNKTAIGDYLGERDEFNIQVLHAFVELHEFTDLNLVQALRQFLWSFRLPGEAQKIDRMMEAFAQRYCQCNNGVFQSTDTCYVLSFAIIMLNTSLHNPNVKDKPTVERFIAMNRGINDGGDLPEELLRNLYESIKNEPFKIPEDDGNDLTHTFFNPDREGWLLKLGGRVKTWKRRWFILTDNCLYYFEYTTDKEPRGIIPLENLSIREVEDSKKPNCFELYIPDNKDQVIKACKTEADGRVVEGNHTVYRISAPTPEEKEEWIKCIKAAISRDPFYEMLAARKKKVSSTKRH

SEQ ID NO: 10719 - protein, 420 aa, Human; identical to SEQ ID NO: 10718

SEQ ID NO: 10720 - protein, 430 aa, Human
PPPRRVPADMAESWLRLSGAGPAEEAGPEGGLEEPDALDDSLTSLQWLQEFSILNAKAPALPPGGTDPHGYHQVPGSAAPGSPLAADPACLGQPHTPGKPTSSCTSRSAPPGLQAPPPDDVDYATNPHVKPPYSYATLICMAMQASKATKITLSAIYKWITDNFCYFRHADPTWQNSIRHNLSLNKCFIKVPREKDEPGKGGFWRIDPQYAERLLSGAFKKRRLPPVHIHPAFARQAAQEPSAVPRAGPLTVNTEAQQLLREFEEATGEAGWGAGEGRLGHKRKQPLPKRVAKVPRPPSTLLPTPEEQGELEPLKGNFDWEAIFDAGTLGGELGALEALELSPPLSPASHVDVDLTIHGRHIDCPATWGPSVEQAADSLDFDETFLATSFLQHPWDESGSGCLPPEPLFEAGDATLASDLQDWASVGAFL

SEQ ID NO: 10721 - protein, 314 aa, Human
RSGSDRIGADRSTPEQAHREGVCETMENGYTYEDYKNTAEWLLSHTKHRPQVAIICGSGLGGLTDKLTQAQIFDYGEIPNFPRSTVPGHAGRLVFGFLNGRACVMMQGRFHMYEGYPLWKVTFPVRVFHLLGVDTLVVTNAAGGLNPKFEVGDIMLIRDHINLPGFSGQNPLRGPNDERFGDRFPAMSDAYDRTMRQRALSTWKQMGEQRELQEGTYVMVAGPSFETVAECRVLQKLGADAVGMSTVPEVIVARHCGLRVFGFSLITNKVIMDYESLEKANHEEVLAAGKQAAQKLEQFVSILMASIPLPDKAS

SEQ ID NO: 10722 - protein, 153 aa, Human
GTSKILMALQRTHSLLLLLLLTLLGLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 10723 - protein, 180 aa, Human
TPEQPAGSVLTGATAQRLGNMVPKLFTSQICLLLLLGLMGVEGSLHARPPQFTRAQWFAIQHISLNPPRCTIAMRAINNYRWRCKNQNTFLRTTFANVVNVCGNQSIRCPHNRTLNNCHRSRFRVPLLHCDLINPGAQNISNCRYADRPGRRFYVVACDNRDPRDSPRYPVVPVHLDTTI

SEQ ID NO: 10724 - protein, 742 aa, Human
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLDEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKSLCLYCQSLYLHSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELW

SEQ ID NO: 10725 - protein, 168 aa, Human
MANLSLHDHDGSSGASDQDTLAPLPHPGAAPWPMAFPYQYPPPPHPYNPHPGFPELGYSYGGGSASSQHSEGKAVGAVAPTVAAAIGGRRRTRRPGTPSPGAAAANRTTPHAAACGGRGSGRPASAQGRRPASTATAATIPWPAAFAATTHTRATVLPECPLSTAPPC

SEQ ID NO: 10726 - protein, 405 aa, Human
GSSLPTMAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 10727 - protein, 300 aa, Human [sequence omitted]

SEQ ID NO: 10728 - protein, 320 aa, Human
TSSRRSPVREASPLGPAALRDSEEKLAPGKNTLQYPRVRGPAFPHSLRASTRSRRSGSRGLTRRAAFGVRAGEGWVCGGPAGSRRRRKLPLTGPGSGSFQCRSRGGRGSVNMGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEEEEDEDEEEEDEDEE

SEQ ID NO: 10729 - protein, 631 aa, Human
PQTIQQTLKRTLQYYEHQVIGYRDAEKNFHNISNRCSYADHSNKEEIEDVSGILQCTANILGLKFEEIQKRFGEEFFNICFHENERVLRAVGGTLQDFFNGFDALLEHIRTSFGKQATLESPSFLCKELPEGTLMLHYFHPHHIVGFAMLGMIKAAGKKIYRLDVEVEQVANEKLCSDVSNPGNCSCLTFLIKECENTNIMKNLPQGTSQVPADLRISINTFCRAFPFHLMFDPSMSVLQLGEGLRKQLRCDTHKVLKFEDCFEIVSPKVNATFERVLLRLSTPFVIRTKPEASGSENKDKVMEVKGQMIHVPESNSILFLGSPCVDKLDELMGRGLHLSDIPIHDATRDVILVGEQAKAQDGLKKRMDKLKATLERTHQALEEEKKKTVDLLYSIFPGDVAQQLWQGQQVQARKFDDVTMLFSDIVGFTAICAQCTPMQVISMLNELYTRFDHQCGFLDIYKVETIGDAYCVAAGLHRKSLCHAKPIALMALKMMELSEEVLTPDGRPIQMRIGIHSGSVLAGVVGVRMPRYCLFGNNVTLASKFESGSHPRRINVSPTTYQLLKREESFTFIPRSREELPDNFPKEIPGICYFLEVRTGPKPPKPSLSSSRIKKVSYNIGTMFLRETSL

SEQ ID NO: 10730 - protein, 1006 aa, Human
GSVTASLSSRRPRPVLCPYRPRSQGRVLAMPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEEVINLVDQTSENAPTTVSRDVEEKPAHAPARPEAPVDSMLKDMATIILSTFLLIGWVAFIITYPLSMHQQQQLQHQQFQKELEKIQLLQQQQQQLPFHPPGDTAQDGELLDTSGPYSESSGTSSPSTSPRASNHSLCSGSSASKAGSSPSLEQDDGDEETSVVIVGKISFCPKDVLGHGAEGTIVYRGMFDNRDVAVKRILPECFSFADREVQLLRESDEHPNVIRYFCTEKDRQFQYIAIELCAATLQEYVEQKDFAHLGLEPITLLQQTTSGLAHLHSLNIVHRDLKPHNILISMPNAHGKIKAMISDFGLCKKLAVGRHSFSRRSGVPGTEGWIAPEMLSEDCKENPTYTVDIFSAGCVFYYVISEGSHPFGKSLQRQANILLGACSLDCLHPEKHEDVIARELIEKMIAMDPQKRPSAKHVLKHPFFWSLEKQLQFFQDVSDRIEKESLDGPIVKQLERGGRAVVKMDWRENITVPLQTDLRKFRTYKGGSVRDLLRAMRNKKHHYRELPAEVRETLGSLPDDFVCYFTSRFPHLLAHTYRAMELCSHERLFQPYYFHEPPEPQPPVTPDAL

SEQ ID NO: 10731 - protein, 442 aa, Human
AVLSINHNKASRGRGRMDGTTAPVTKSGAAKLVKRNFLEALKSNDFGKLKAILIQRQIDVDTVFEVEDENMVLASYKQGYWLPSYKLKSSWATGLHLSVLFGHVECLLVLLDHNATINCRPNGKTPLHVACEMANVDCVKILCDRGAKLNCYSLSGHTALHFCTTPSSILCAKQLVWRGANVNMKTNNQDEETPLHTAAHFGLSELVAFYVEHGAIVDSVNAHMETPLAIAAYWALRFKEQEYSTEHHLVCRMLLDYKAEVNARDDDFKSPLHKAAWNCDHVLMHMMLEAGAEANLMDINGCAAIQYVLKVTSVRPAAQPEICYQLLLNHGAARIYPPQFHKVIQACHSCPKAIEVVVNAYEHIRWNTKWRRAIPDDDLEKYWDFYHSLFTVCCNSPRTLMHLSRCAIRRTLHNRCHRAIPLLSLPLSLKKYLLLEPEGIIY

SEQ ID NO: 10732 - protein, 506 aa, Human
TYRRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 10733 - protein, 510 aa, Human
ASPPPARPQAQRARPRAPHSRRRAMLHLSEFSEPDALLVKSTEGCCAEPSAELPRLPARDAPAATGYPGAGDFLSWALNSCGASGDLADSCFLEGPAPTPPPGLSYSGSFFIQAVPEHPHDPEALFNLMSGILGLAPFPGPEAAASRSPLDAPFPAGSDALLPGPPDLYSPDLGAAPFPEAFWEASPCAGAPSQCLYEPQLSPPDVKPGLRAPPASPALDAVSAFKGPYAPWELLSVGAPGNCGSQGDYQAAPEARFPVIGTKIEDLLSISCPAELPAVPANRLYPSGAYDAFPLAPGDLGEGAEGLPGLLTPPSGEGGSSGDGGEFLASTQPQLSPLGLRSAAAADFPKPLVADIPGSSGVAAPPVPPPPPTPFPQAKARRKGRRGGKCSTRCFCPRPHAKAFACPVESCVRSFARSDELNRHLRIHTGHKPFQCRICLRNFSRSDHLTTHVRTHTGEKPFACDVCGRRFARSDEKKRHSKVHLKQKARAEERLKGLGFYSLGLSFASL

SEQ ID NO: 10734 - protein, 248 aa, Human
RAPQRSGGGSEPVGSGGWSRGSGPRCRMAAAVRMNIQMLLEAADYLERREREAEHGYASMLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 10735 - protein, 116 aa, Human
QEMFSSTWKDRQQPTLIWKTGPRLDTRGTKPGMGWPLCPRRRDGQNGPRVLFPEKGEKDGIATHPPTLVREENLCFWSFSRDCVLQVQKTACYLQARFSRAHGSPVAFSVNLAGMD

SEQ ID NO: 10736 - protein, 413 aa, Human
PLVSRETPLSCSHNRLNDLGGSEGQGAGPGGAAATAAAMEDEMPKTLYVGNLSRDVTEALILQLFSQIGPCKNCKMIMDTAGNDPYCFVEFHEHRHAAAALAAMNGRKIMGKEVKVNWATTPSSQKKDTSNHFHVFVGDLSPEITTEDIKAAFAPFGRISDARVVKDMATGKSKGYGFVSFFNKWDAENAIQQMGGQWLGGRQIRTNWATRKPPAPKSTYESNTKQLSYDEVVNQSSPSNCTVYCGGVTSGLTEQLMRQTFSPFGQIMEIRVFPDKGYSFVRFNSHESAAHAIVSVNGTTIEGHVVKCYWGKETLDMINPVQQQNQIGYPQPYGQWGQWYGNAQQIGQYMPNGWQVPAYGMYGQAWNQQGFNQTQSSAPWMGPNYGVQPPQGQNGSMLPNQPSGYRVAGYETQ

SEQ ID NO: 10737 - protein, 413 aa, Human; identical to SEQ ID NO: 10736

SEQ ID NO: 10738 - protein, 321 aa, Human
ERTLGQPGFLGCPRQPHTAMHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHWVIADGEDTTVRASTHCTYDRVVLHGERCRSLLHTAAAFDFPTSFQLTEEEALNISDHYPVEVELKLSQAHSVQPLSLTVLLLLSLLSPQLCPAA

SEQ ID NO: 10739 - protein, 222 aa, Human
YVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIRK

SEQ ID NO: 10740 - protein, 222 aa, Human; identical to SEQ ID NO: 10739

SEQ ID NO: 10741 - protein, 181 aa, Human
DCWSAWNFSGGHQSMEHIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 10742 - protein, 786 aa, Human
PGGRGRMEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 10743 - protein, 175 aa, Human
MSHSQHSPYLQSYHNSSAAAQTRGDDTDQQKTTVIENGEIRFNGKGKKIRKPRTIYSSLQLQALNHRFQQTQYLALPERAELAASLGLTQTQVKIWFQNKRSKFKKLLKQGSNPHESDPLQGSAALSPRSPALPPVWDVSASAKGVSMPPNSYMPGYSHWYSSPHQDTMQRPQMM

SEQ ID NO: 10744 - protein, 289 aa, Human
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVKIWFQNKRSKIKKIMKNGEMPPEHSPSSSDPMACNSPQSPAVWEPQGSSRSLSHHPHAHPPTSNQSPASSYLENSASWYTSAASSINSHLPPPGSLQHPLALASGTLY

SEQ ID NO: 10745 - protein, 749 aa, Human
RRWRGGDPAGITRGLPDPAKMQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLGMKKLKEEMEGVVKELAENNHILERFGSLTMDGGLRNVDCL

SEQ ID NO: 10746 - protein, 794 aa, Human
QQELKRMGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 10747 - protein, 1195 aa, Human
LQTQRNYGPPVRPRMGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 10748 - protein, 195 aa, Human
YLLFVKNMSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKEIYEESSTWKGNKECFWASNS

SEQ ID NO: 10749 - protein, 168 aa, Human
LCVILEPMQELMSRHKTYNLSPRDCLKTCLFQKWQRMVAPPAEPTRQPTTKRRKRKNSTSSTSNSSAGNNANSTGSKKKTTAANLSLSSQVPDVMVVGEPTLMGGEFGDEDERLITRLENTQYDAANGMDDEEDFNNSPALGNNSPWNSKPPATQETKSENPPPQASQ

SEQ ID NO: 10750 - protein, 216 aa, Human
AAAAMAYAYLFKYIIIGDTGVGKSCLLLQFTDKRFQPVHDLTIGVEFGARMITIDGKQIKLQIWDTAGQESFRSITRSYYRGAAGALLVYDITRRDTFNHLTTWLEDARQHSNSNMVIMLIGNKSDLESRREVKKEEGEAFAREHGLIFMETSAKTASNVEEAFINTAKEIYEKIQEGVFDINNEANGIKIGPQHAATNATHAGNQGGQQAGGGCC

SEQ ID NO: 10751 - protein, 135 aa, Human
HPVWSTGPPRVWGADWSTLRAVMSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 10752 - protein, 584 aa, Human
VTMSSSLGKEKDSKEKDPKVPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGELCNLITLDVAHNQLEHLPKEIGNCTQITNLDLQHNELLDLPDTIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 10753 - protein, 78 aa, Human
LCFCLPPDYLYCGFKYATFSQHPIIMAPQFICGHPGFRARSLALYKCIHKISELVGHEHQTFVPLIWLCLEKTANQKE

SEQ ID NO: 10754 - protein, 547 aa, Human
SFSLQAVFGLKLSWPPSFYLIMSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 10755 - protein, 263 aa, Human
FSSMAKSPLEGVSSSRGLHAGRGPRRLSIEGNIAVGKSTFVKLLTKTYPEWHVATEPVATWQNIQAAGTQKACTAQSLGNLLDMMYREPARWSYTFQTFSFLSRLKVQLEPFPEKLLQARKPVQIFERSVYSDRYIFAKNLFENGSLSDIEWHIYQDWHSFLLWEFASRITLHGFIYLQASPQVCLKRLYQRAREEEKGIELAYLEQLHGQHEAWLIHKTTKLHFEALMNIPVLVLDVNDDFSEEVTKQEDLMREVNTFVKNL

SEQ ID NO: 10756 - protein, 349 aa, Human
AATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 10757 - protein, 402 aa, Human
TSPQSLGEEPLIPSVLQSPAHSATYTMCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 10758 - protein, 296 aa, Human
PRRDAEDRDESCLNPAFPIGLLHPNSVNSMARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEVSKRYGGFMRGLKRSPQLEDEAKELQKRYGGFMRRVGRPEWWMDYQKRYGGFLKRFAEALPSDEEGESYSKEVPEMEKRYGGFMRF

SEQ ID NO: 10759 - protein, 364 aa, Human
MAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLADFGVSAKNLKTLQKRDSFIGTPYWMAPEVVMCETMKDTPYDYKADIWSLGITLIEMAQIEPPHHELNPMRVLLKIAKSDPPTLLTPSKWSVEFRDFLKIALDKNPETRPSAAQLLEHPFVSSITSNKALRELVAEAKAEVMEEIEDGRDEGEEEDAVDAASSWPLEMRTAWQCLCPCGSPDPCQWMPEFR

SEQ ID NO: 10760 - protein, 455 aa, Human
DSWLLQGCGRWSSVLLTQVQRAFSLVLQLLLYRRRRRRRRLLCGVMVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAGYEQF

SEQ ID NO: 10761 - protein, 455 aa, Human; identical to SEQ ID NO: 10760

SEQ ID NO: 10762 - protein, 736 aa, Human
GLFQPIVFNLLFLITLTIGMIDPDFADKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 10763 - protein, 411 aa, Human
PMETRPTALMSSTVAAAAPAAGAASRKESPGRWGLGEDPTGVSPSLQCRVCGDSSSGKHYGIYACNGCSGFFKRSVRRRLIYRCQVGAGMCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVRFGKLLLLLPSLRFITAERIELLFFRKTIGNTPMEKLLCDMFKN

SEQ ID NO: 10764 - protein, 411 aa, Human; identical to SEQ ID NO: 10763

SEQ ID NO: 10765 - protein, 353 aa, Human
MGQRPGGVGVPRAAAMEQLRAAARLQIVLGHLGRPSAGAVVAHPTSGTISSASFHPQQFQYTLDNNVLTLEQRKFYEENGFLVIKNLVPDADIQRFRNEFEKICRKEVKPLGLTVMRDVTISKSEYAPSEKMITKVQDFQEDKELFRYCTLPEILKYVECFTGPNIMAMHTMLINKPPDSGKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRKAISCHFASADCHYIDVKGTSQENIEKEVVGIAHKFFGAENSVNLKDIWMFRARLVKGERTNL

SEQ ID NO: 10766 - protein, 339 aa, Human
QPARAPASLPPRVPRCPPRAGAMRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPWVVPNNQGIAQEEALHLIDEMDLNGDKKLSEEEILENPDLFLTSEATDYGRQLHDDYFYHDEL

SEQ ID NO: 10767 - protein, 459 aa, Human
LGDARAPEKMSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 10768 - protein, 432 aa, Human
REKLGNVESVYVIDPEDVALLFKSEGPNPERFLIPPWVAYHQYYQRPIGVLLKKSAAWKKDRVALNQEVMAPEATKNFLPLLDAVSRDFVSVLHRRIKKAGSGNYSGDISDDLFRFAFESITNVIFGERQGMLEEVVNPEAQRFIDAIYQMFHTSVPMLNLPPDLFRLFRTKTWKDHVAAWDVIFSKADIYTQNFYWELRQKGSVHHDYRGILYRLLGDSKMSFEDIKANVTEMLAGGVDTTSMTLQWHLYEMARNLKVQDMLRAEVLAARHQAQGDMATMLQLVPLLKASIKETLRLHPISVTLQRYLVNDLVLRDYMIPAKTLVQVAIYALGREPTFFFDPENFDPTRWLSKDKNITYFRNLGFGWGVRQCLGRRIAELEMTIFLINMLENFRVEIQHLSDVGTTFNLILMPEKPISFTFWPFNQEATQQ

SEQ ID NO: 10769 - protein, 516 aa, Human
MALSQSVPFSATELLLASAIFCLVFWVLKGLRPRVPKGLKSPPEPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKNSVRDITGALFKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 10770 - protein, 680 aa, Human
PLQRRALSRHLPFRTAQGTQPTGSRLPFSFSSRTPRSKPRIETKLGSMEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 10771 - protein, 1109 aa, Human
RFRGSLASLGSRGGGSGGTGSGSSHGHLHDSAEERRLIAEGDASPGEDRTPPGLAAEPERPGASAQPAASPPPPQQPPQPASASCEQPSVDTAIKVEGGAAAGDQILPEAEVRLGQAGFMQRQFGAMLQPGVNKFSLRMFGSQKAVEREQERVKSAGFWIIHPYSDFRFYWDLTMLLLMVGNLIIIPVGITFFKDENTTPWIVFNVVSDTFFLIDLVLNFRTGIVVEDNTEIILDPQRIKMKYLKSWFMVDFISSIPVDYIFLIVETRIDSEVYKTARALRIVRFTKILSLLRLLRLSRLIRYIHQWEEIFHMTYDLASAVVRIVNLIGMMLLLCHWDGCLQFLVPMLQDFPDDCWVSINNMVNNSWGKQYSYALFKAMSHMLCIGYGRQAPVGMSDVWLTMLSMIVGATCYAMFIGHATALIQSLDSSRRQYQEKYKQVEQYMSFHKLPPDTRQRIHDYYEHRYQGKMFDEESILGELSEPLREEIINFNCRKLVASMPLFANADPNFVTSMLTKLRFEVFQPGDYIIREGTIGKKMYFIQHGVVSVLTKGNKETKLADGSYFGEICLLTRGRRTASVRADTYCRLYSLSVDNFNEVLEEYPMMRRAFETVALDRLDRIGKKNSILLHKVQHDLNSGVFNYQENEIIQQIVQHDREMAHCAHRVQAAASATPTPTPVIWTPLIQAPLQAAAATTSVAIALTHHPRLPAAIFRPPPGSGLGNLGAGQTPRHLKRLQSLIPSALGSASPASSPSQVDTPSSSSFHIQQLAGFSAPAGLSPLLPSSSSSPPPGACGSPSAPTPSAGVAATTIAGFGHFHKALGGSLSSSDSPLLTPLQPGARSPQAAQPSPAPPGARGGLGLPEHFLPPPPSSRSPSSSPGQLGQPPGELSLGLATGPLSTPETPPRQPEPPSLVAGASGGASPVGFTPRGGLSPPGHSPGPPRTFPSAPPRASGSHGSLLLPPASSPPPPQVPQRRGTPPLTPGRLTQDLKLISASQPALPQDGAQTLRRASPHSSGESMAAFPLFPRAGGGSGGSGSSGGLGPPGRPYGAIPGQHVTLPRKTSSGSLPPPLSLFGARATSSGGPPLTAGPQREPGARPEPVRSKLPSNL

SEQ ID NO: 10772 - protein, 614 aa, Human
LVARPSVGSSDPPGTPPDPSPPAAAHCLAMTITYTSQVANARLGSFSRLLLCWRGSIYKLLYGEFLIFLLCYYIIRFIYRLALTEEQQLMFEKLTLYCDSYIQLIPISFVLGFYVTLVVTRWWNQYENLPWPDRLMSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQVVTVAVYSFFLTCLVGRQFLNPAKAYPGHELDLVVPVFTFLQFFFYVGWLKVAEQLINPFGEDDDDFETNWIVDRNLQVSLLAVDEMHQDLPRMEPDMYWNKPEPQPPYTAASAQFRRASFMGSTFNISLNKEEMEFQPNQEDEEDAHAGIIGRFLGLQSHDHHPPRANSRTKLLWPKRESLLHEGLPKNHKAAKQNVRGQEDNKAWKLKAVDAFKSAPLYQRPGYYSAPQTPLSPTPMFFPLEPSAPSKLHSVTGIDTKDKSLKTVSSGAKKSFELLSESDGALMEHPEVSQVRRKTVEFNLTDMPEIPENHLKEPLEQSPTNIHTTLKDHMDPYWALENRDEAHS

SEQ ID NO: 10773 - protein, 220 aa, Human
PALRHLFTAPSDCPKAPAAAPAPRSHRRRRRLSLVAAMTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 10774 - protein, 409 aa, Human
DRLPGATPNQALAAEAACPKGQSSLLCVAMGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 10775 - protein, 489 aa, Human
AAAAGRGRSSGRRRRRRPGALFASLGVLLGPRPPPGIPRTRACSMGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 10776 - protein, 665 aa, Human
TPLKMRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMHYGCASGYKTTGGKDEEVVQCLSDGWSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSTLSYQEPLRT

SEQ ID NO: 10777 - protein, 334 aa, Human
HMEAGGATGALGVGCKLPSAFCFPGSSVAMDMFQKVEKIGEGTYGVVYKAKNRETGQLVALKKIRLDLEMEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVVTLWYRAPEILLGSKFYTTAVDIWSIGCIFAEMVTRKALFPGDSEIDQLFRIFRMLGTPSEDTWPGVTQLPDYKGSFPKWTRKGLEEIVPNLEPEGRDLLMQLLQYDPSQRITAKTALAHPYFSSPEPSPAARQYVLQRFRH

SEQ ID NO: 10778 - protein, 430 aa, Human
AVPVDERHRRESEMAWFALYLLSLLWATAGTSTQTQSSCSVPSAQEPLVNGIQVLMENSVTSSAYPNPSILIAMNLAGAYNLKAQKLLTYQLMSSDNNDLTIGQLGLTIMALTSSCRDPGDKVSILQRQMENWAPSSPNAEASAFYGPSLAILALCQKNSEATLPIAVRFAKTLLANSSPFNVDTGAMATLALTCMYNKIPVGSEEGYRSLFGQVLKDIVEKISMKIKDNGIIGDIYSTGLAMQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGVADYIPFNHEHITANFTQY

SEQ ID NO: 10779 - protein, 688 aa, Human
YRSKAEMRHTCRGTINLATANITVEDSCNFIISNGGAQTYHLKASSEVERQRWVTALELAKAKAVKMLAESDESGDEESVSQTDKTELQNTLRTLSSKVEDLSTCNDLIAKHGTALQRSLSELESLKLPAESNEKIKQVNERATLFRITSNAMINACRDFLMLAQTHSKKWQKSLQYERDQRIRLEETLEQLAKQHNHLERAFRGATVLPANTPGNVGSGKDQCCSGKGDMSDEDDENEFFDAPEIITMPENLGHKRTGSNISGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVSHHPPAAAHHAESKNGWTLRQEIKITSKFRGKYLSIMPLGTIHCIFHATGHHYTWKKVTTTVHNIIVGKLWIDQSGEIDIVNHKTGDKCNLKFVPYSYFSRDVARKVTGEVTDPSGKVHFALLGTWDEKMECFKVQPVIGENGGDARQRGHEAEESRVMLWKRNPLPKNAENMYYFSELALTLNAWESGTAPTDSRLRPDQRLMENGRWDEANAEKQRLEEKQRLSRKKREAEAMKATEDGTPYDPYKALWFERKKDPVTKELTHIYRGEYWECKEKQDWSSCPDIF

SEQ ID NO: 10780 - protein, 289 aa, Human
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 10781 - protein, 530 aa, Human
TLPPGKYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 10782 - protein, 878 aa, Human
YANVHEKDYIPVKGEVCIAKYTVDQTWNRAIIQNVDVQQKKAHVLYIDYGNEEIIPLNRIYHLNRNIDLFPPCAIKCFVANVIPAEGNWSSDCIKATKPLLMEQYCSIKIVDILEEEVVTFAVEVELPNSGKLLDHVLIEMGYGLKPSGQDSKKENADQSDPEDVGKMTTENNIVVDKSDLIPKVLTLNVGDEFCGVVAHIQTPEDFFCQQLQSGRKLAELQASLSKYCDQLPPRSDFYPAIGDICCAQFSEDDQWYRASVLAYASEESVLVGYVDYGNFEILSLMRLCPIIPKLLELPMQAIKCVLAGVKPSLGIWTPEAICLMKKLVQNKIITVKVVDKLENSSLVELIDKSETPHVSVSKVLLDAGFAVGEQSMVTDKPSDVKETSVPLGVEGKVNPLEWTWVELGVDQTVDVVVCVIYSPGEFYCHVLKEDALKKLNDLNKSLAEHCQQKLPNGFKAEIGQPCCAFFAGDGSWYRALVKEILPNGHVKVHFVDYGNIEEVTADELRMISSTFLNLPFQGIRCQLADIQSRNKHWSEEAITRFQMCVAGIKLQARVVEVTENGIGVELTDLSTCYPRIISDVLIDEHLVLKSASPHKDLPNDRLVNKHELQVHVQGLQATSSAEQWKTIELPVDKTIQANVLEIISPNLFYALPKGMPENQEKLCMLTAELLEYCNAPKSRPPYRPRIGDACCAKYTSDDFWYRAVVLGTSDTDVEVLYADYGNIETLPLCRVQPITSSHLALPFQIIRCSLEGLMELNGSSSQLIIMLLKNFMLNQNVMLSVKGITKNVHTVSVEKCSENGTVDVADKLVTFGLAKNITPQRQSALNTEKMYRMNCCCTELQKQVEKHEHILLFLLNNSTNQNKFIEMKKLLKS

SEQ ID NO: 10783 - protein, 428 aa, Human
LLQAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRVADTPRWPHACNENGPRSVYAQHVGTKGKYFHMKCSW

SEQ ID NO: 10784 - protein, 428 aa, Human; identical to SEQ ID NO: 10783

SEQ ID NO: 10785 - protein, 428 aa, Human; identical to SEQ ID NO: 10783

SEQ ID NO: 10786 - protein, 560 aa, Human
SLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 10787 - protein, 148 aa, Human
PMALKRIQKELSDLQRDPPAHCSAGPVGDDLFHWQATIMGPPDSAYQGGVFFLTVHFPTDYPFKPPKIAFTTKIYHPNINSNGSICLDILRSQWSPALTVSKVLLSICSLLCDPNPDDPLVPDIAQIYKSDKEKYNRHAREWTQKYAM

SEQ ID NO: 10788 - protein, 490 aa, Human
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTCLAPEVLVSVGTAGYNRAVDCWSLGVILFICLSGYPPFSEHRTQVSLKDQITSGKYNFIPEVWAEVSEKALDLVKKLLVVDPKARFTTEEALRHRGFRMKT

SEQ ID NO: 10789 - protein, 264 aa, Human
SGAMVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 10790 - protein, 729 aa, Human
ELEATMGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 10791 - protein, 729 aa, Human; identical to SEQ ID NO: 10790

SEQ ID NO: 10792 - protein, 441 aa, Human
TAKMFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIGNIAQVKASGWSLCSRIQIREDCVLA

SEQ ID NO: 10793 - protein, 468 aa, Human
YLQMKWPLLDVQAGSLQSRQALKDARSPSPAHISNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 10794 - protein, 300 aa, Human
AVEGLAVAVSMGDGGAERDRGPARRAESGGGGGRCGDRSGAGDLRADGGGHSPTEVAGTSASSPAGSRESGADSDGQPGPGEADHCRRILVRDAKGTIREIVLPKGLDLDRPKRTRTSFTAEQLYRLEMEFQRCQYVVGRERTELARQLNLSETQVKVWFQNRRTKQKKDQSRDLEKRASSSASEAFATSNILRLLEQGRLLSVPRAPSLLALTPSLPGLPASHRGTSLGDPRNSSPRLNPLSSASASPPLPPPLPAVCFSSAPLLDLPAGYELGSSAFEPYSWLERKVGSASSCKKANT

SEQ ID NO: 10795 - protein, 542 aa, Human
LSPAPAGPEVSELPPAAGSDTGLPAGDCSMAMEIDSRPGGLPGSSCNLGAAREHMQAVTRNYITHPRVTYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVNMETARFFKSDFEQNGTMGNVCLFLNLANDPTIERIITPRLALTTAEFLAYQCEKHVLVILTDMSSYAEALREVSAAREEVPGRRGFPGYMYTDLATIYERAGRVEGRGGSITQIPILTMPNDDITHPIPDLTGFITEGQIYVDRQLHNRQIYPPINVLPSLSRLMKSAIGEGMTRKDHGDVSNQLYACYAIGKDVQAMKAVVGEEALTSEDLLYLEFLQKFEKNFINQGPYENRSVFESLDLGWKLLRIFPKEMLKRIPQAVIDEFYSREGALQDLAPDTAL

SEQ ID NO: 10796 - protein, 1766 aa, Human
TAPPPSPSLPLQDRAATSAHLALFTLSFQSTFLLFPAGCSAYLNLLRPPTSLAALGVPFSKTMAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 10797 - protein, 342 aa, Human [sequence omitted]

SEQ ID NO: 10798 - protein, 792 aa, Human
HLPAARCDMEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 10799 - protein, 378 aa, Human
AAASVPPSLSLRAMGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQASSCHQRPLSSGGDPQVPPMTRGLAGACHLQTLALRNGPTVAPSGWQPPFSEAPRQSRLGVDQGPWTRDVLLCTSVPHLWDGLH

SEQ ID NO: 10800 - protein, 304 aa, Human
VKMALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 10801 - protein, 563 aa, Human
SPATPNGTKEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRIEAITSSGQMGSFIRLKQFLEKCLQHKDIPVPKGFLTSSFWRS

SEQ ID NO: 10802 - protein, 507 aa, Human
ICKMMTTSLIWGIAIAACCCLWLILGIRRRQTGEPPLENGLIPYLGCALQFGANPLEFLRANQRKHGHVFTCKLMGKYVHFITNPLSYHKVLCHGKYFDWKKFHFATSAKAFGHRSIDPMDGNTTENINDTFIKTLQGHALNSLTESMMENLQRIMRPPVSSNSKTAAWVTEGMYSFCYRVMFEAGYLTIFGRDLTRRDTQKAHILNNLDNFKQFDKVFPALVAGLPIHMFRTAHNAREKLAESLRHENLQKRESISELISLRMFLNDTLSTFDDLEKAKTHLVVLWASQANTIPATFWSLFQMIRNPEAMKAATEEVKRTLENAGQKVSLEGNPICLSQAELNDLPVLDSIIKESLRLSSASLNIRTAKEDFTLHLEDGSYNIRKDDIIALYPQLMHLDPEIYPDPLTFKYDRYLDENGKTKTTFYCNGLKLKYYYMPFGSGATICPGRLFAIHEIKQFLILMLSYFELELIEGQAKCPPLDQSRAGLGILPPLNDIEFKYKFKHL

SEQ ID NO: 10803 - protein, 446 aa, Human
RMALVDKHKVKRQRLDRICEGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 10804 - protein, 446 aa, Human; identical to SEQ ID NO: 10803

SEQ ID NO: 10805 - protein, 542 aa, Human
RQKKMEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 10806 - protein, 964 aa, Human
PSLCAVRTPSSRPGSRAPAQSSRTAPPASPLASPPRFPNSAPSGRGRMIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 10807 - protein, 271 aa, Human
SDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 10808 - protein, 491 aa, Human
PGRMAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 10809 - protein, 127 aa, Human
GAVSVPLPAMPFLELDTNLPANRVPAGLEKRLCAAAASILGKPADRVNVTVRPGLAMALSGSTEPCAQLSISSIGVVGTAEDNRSHSAHFFEFLTKELALGQDRILIRFFPLESWQIGKIGTVMTFL

SEQ ID NO: 10810 - protein, 399 aa, Human
SLAARLRPPASAAAMMMMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 10811 - protein, 110 aa, Human
SKMAAAMDVDTPSGTNSGAGKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 10812 - protein, 433 aa, Human
LSRALPADSLGTQAQGLEPRDESAQGRCEPGGLPANLSLKPQKRALRPGLPCLRPSMRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDFLGIAWSDAVLHHEDLIGKPGGVSLSKIERSTDQVIKPVNLEALSKWTGHIPGDVVRDMAQIAPMLAQLGYDPYANPPNYGNPDPFVINNTQRVLKGDYKTPANLKGYFQVNQNSTSSHLGSS

SEQ ID NO: 10813 - protein, 213 aa, Human
LNMGKGDPKKLRGKMSSHAFFGQTCREAHKKKHPDASVNLSEFSKKCSERWKTMSAKEKGKFEDMAKADKAHYEREMKTYIPPKGETKKKFKDPNAPKRTPSAFFLFCSAYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEDEEDEDEEDDE

SEQ ID NO: 10814 - protein, 207 aa, Human
MFPGPISEGATMTLQCTKSAGPWKMVVWDEDGFQGRRHEFTAECPSVLELGFETVRSLKVLSGAWVGFEHAGFQGQQYILERGEYPSWDAWGGNTAYPAERLTSFRPAACANHRDSRLTIFEQENFLGKKGELSDDYPSLQAMGWEGNEVGSFHVHSGAWVCSQFPGYRGFQYVLECDHHSGDYKHFREWGSHAPTFQVQSIRRIQQ

SEQ ID NO: 10815 - protein, 262 aa, Human
QVPRLLQAGTMSQAAKASASATVAVNPGPDTKGKGAPPAGTSPSPGTTLAPTTVPITSAKAAELPPGNYRLVVFELENFQGRRAEFSGECSNLADRGFDRVRSIIVSAGPWVAFEQSNFRGEMFILEKGEYPRWNTWSSSYRSDRLMSFRPIKMDAQEHKISLFEGANFKGNTIEIQGDDAPSLWVYGFSDRVGSVKVSSGTWVGYQYPGYRGYQYLLEPGDFRHWNEWGAFQPQMQSLRRLRDKQWHLEGSFPVLATEPPK

SEQ ID NO: 10816 - protein, 343 aa, Human
MSLEWLVAWSWSLDGLRDCIATGIQSVRDCDTTAVITVACLLVLFVWYCYHVGREQPRPYVSVNSLMQAADANGLQNGYVYCQSPECVRCTHNEGLNQKLYHNLQEYAKRYSWSGMGRIHKGIREQGRYLNSRPSIQKPEVFFLPDLPTTPYFSRDAQKHDVEVLERNFQTILCEFETLYKAFSNCSLPQGWKMNSTPSGEWFTFYLVNQGVCVPRNCRKCPRTYRLLGSLRTCIGNNVFGNACISVLSPGTVITEHYGPTNIRIRCHLGLKTPNGCELVVGGEPQCWAEGRCLLFDDSFLHAAFHEGSAEDGPRVVFMVDLWHPNVAAAERQALDFIFAPGR

SEQ ID NO: 10817 - protein, 1388 aa, Human
AEPAAKMPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 10818 - protein, 205 aa, Human
QSHETKMQSGTHWRVLGLCLLSGNEEMGKKISTYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 10819 - protein, 263 aa, Human
VTGTGEELNSNSSLWENAVLAPPGVALAGCWSPRSAPSGLWGQGWVSLMYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 10820 - protein, 225 aa, Human
PTRLTSQSLKMHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 10821 - protein, 549 aa, Human [sequence omitted]

SEQ ID NO: 10822 - protein, 383 aa, Human
MASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGENVDISRPPEEALVTVPAHQ

SEQ ID NO: 10823 - protein, 287 aa, Human
VIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 10824 - protein, 262 aa, Human
HPLNKDTRHRDPNFPKMEEAKSQSLEEDFEGQATHTGPKGVINDWRKFKLESQDSDSIPPSKKEILRQMSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 10825 - protein, 262 aa, Human; identical to SEQ ID NO: 10824

SEQ ID NO: 10826 - protein, 262 aa, Human; identical to SEQ ID NO: 10824

SEQ ID NO: 10827 - protein, 1411 aa, Human
LRYLKTTMAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTCDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 10828 - protein, 2186 aa, Human
NWMNFKLLMFLLRQYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 10829 - protein, 776 aa, Human
HLRSSGQREGEQGGSPAAADLLGPGPSPSPAPASPDGAMRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDGKTLPSWGQALLSQDFELLCRDGSRADVTEWRQCHLARVPAHAVVVRADTDGGLIFRLLNEGQRLFSHEGSSFQMFSSEAYGQKDLLFKDSTSELVPIATQTYEAWLGHEYLHAMKGLLCDPNRLPPYLRWCVLSTPEIQKCGDMAVAFRRQRLKPEIQCVSAKSPQHCMERIQAEQVDAVTLSGEDIYTAGKTYGLVPAAGEHYAPEDSSNSYYVVAVVRRDSSHAFTLDELRGKRSCHAGFGSPAGWDVPVGALIQRGFIRPKDCDVLTAVSEFFNASCVPVNNPKNYPSSLCALCVGDEQGRNKCVGNSQERYYGYRGAFRCLVENAGDVAFVRHTTVFDNTNGHNSEPWAAELRSEDYELLCPNGARAEVSQFAACNLAQIPPHAVMVRPDTNIFTVYGLLDKAQDLFGDDHNKNGFKMFDSSNYHGQDLLFKDATVRAVPVGEKTTYRGWLGLDYVAALEGMSSQQCSGAAAPAPGAPLLPLLLPALAARLLPPAL

SEQ ID NO: 10830 - protein, 209 aa, Human
GQSTMASDHQTQAGKPQSLNPKIIIFEQENFQGHSHELNGPCPNLKETGVEKAGSVLVQAGPWVGYEQANCKGEQFVFEKGEYPRWDSWTSSRRTDSLSSLRPIKVDSQEHKIILYENPNFTGKKMEIIDDDVPSFHAHGYQEKVSSVWVRSGTWVGYQYPGYRGLQYLLEKGDYKDSSDFGAPHPQVQSVRRIRDMQWHQRGAFHPSN

SEQ ID NO: 10831 - protein, 371 aa, Human
PLIPLHPANRSPATMAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 10832 - protein, 725 aa, Human
RGSMEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTAHGAPERPLAATSAAPPPQPQPQPPPQPEPRSVPQPEPEPEPEREATPTPAPAAPEEPPAPPEFRCQVCGQSFTQSWFLKGHMRKHKASFDHACPVCGRCFKEPWFLKNHMKVHASKLGPLRAPGPASGPARAPQPPDLGLLAYEPLGPALLLAPAPTPAERREPPSLLGYLSLRAGEGRPNGEGAEPGPGRSFGGFRPLSSALPARARRHRAEEPEEEEEVVEAEEETWARGRSLGSLASLHPRPGEGPGHSASAAGAQARSTATQEENGLLVGGTRPEGGRGATGKDCPFCGKSFRSAHHLKVHLRVHTGERPYKCPHCDYAGTQSGSLKYHLQRHHREQRSGAGPGPPPEPPPPSQRGSAPQSGAKPSPQPATWVEGASSPRPPSSGAGPGSRRKPASPGRTLRNGRGGEAEPLDLSLRAGPGGEAGPGGALHRCLFCPFATGAPELMALHLQVHHSRRARGRRPPQADASPPYARVPSGETPPSPSQEGEEGSGLSRPGEAGLGGQER

SEQ ID NO: 10833 - protein, 703 aa, Human
PSNIWQLKDVAYGTRPLSLCLETLPAHGDEDKVDISLLHQGENLFELHIHQAFLTSAALAQAGDTQPTTFCTYSFYDFETHCTPLSVGPQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 10834 - protein, 580 aa, Human
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRRIINKHTDESLGDCSFLNTCFHMDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWGYERVDEIIWVKTNQLQRIIRTGRTGHWLNHGKEHCLVGVKGNPQGFNQGLDCDVIVAEVRSTSHKPDEIYGMIERLSPGTRKIELFGRPHNVQPNWITLGNQLDGIHLLDPDVVARFKQRYPDGIISKPKNL

SEQ ID NO: 10835 - protein, 577 aa, Human
TEARRLGERRRGGRDRAWTAVDTASCAGKRAARSRRRAPGTEKGSPGDLRPSMHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQAVGSCPRLTPPPADLPLALPAHGLWSRHILQQTLMDEGLRLARLVSHDRVGRLSPCVPAKPPLAEFEEGLLDRCPAPGPHPALVEGRRSSVKVEAEASRQ

SEQ ID NO: 10836 - protein, 493 aa, Human
IESMRASRQVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKAKVPGSAVPEAGRDPEGKALCQ

SEQ ID NO: 10837 - protein, 137 aa, Human
SCQTTQPPAQSCSTGTMRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPDSPTDVNQENVPSFGILKYPPRAE

SEQ ID NO: 10838 - protein, 415 aa, Human
ATSKSQIMSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALHR

SEQ ID NO: 10839 - protein, 382 aa, Human
LVPPLLPLVLSATCCPDTSRAGRRVRGRAAAPCREAARGRGQRRFLPPTWRCETGAATMFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKELCALQKAVELEKTEADNAERPRARRRRKPRVLFSQAQVYELERRFKQQRYLSAPERDQLASVLKLTSTQVKIWFQNRRYKCKRQRQDQTLELVGLPPPPPPPARRIAVPVLVRDGKPCLGDSAPYAPAYGVGLNPYGYNAYPAYPGYGGAACSPGYSCTAAYPAGPSPAQPATAAANNNFVNFGVGDLNAVQSPGIPQSNSGVSTLHGIRAW

SEQ ID NO: 10840 - protein, 449 aa, Human [sequence omitted]

SEQ ID NO: 10841 - protein, 198 aa, Human
GVPNMAAPQDVHVRICNQEIVKFDLEVKALIQDIRDCSGPLSALTELNTKVKEKFQQLRHRIQDLEQLAKEQDKESEKQLLLQEVENHKKQMLRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 10842 - protein, 198 aa, Human; identical to SEQ ID NO: 10841

SEQ ID NO: 10843 - protein, 198 aa, Human; identical to SEQ ID NO: 10841

SEQ ID NO: 10844 - protein, 198 aa, Human; identical to SEQ ID NO: 10841

SEQ ID NO: 10845 - protein, 93 aa, Human
GDGVGVGAQAATMAYHGLTVPLIVMSVFWGFVGFLVPWFIPKGPNRGVIITMLVTCSVCCYLFWLIAILAQLNPLFGPQLKNETIWYLKYHWP

SEQ ID NO: 10846 - protein, 839 aa, Human
AGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSEVGGAEVPERACASEEVPTLTYEERVGFKKSRDVFGLDFGTTSAKQPTQPASELPSGRLFHAAAVISDAMYIFGGTVDNNIRSGEMYRFQFSCYPKCTLHEDYGRLWESRQFCDVEFVLGEKEECVQGHVAIVTARSRWLRRKITQARERLAQKLEQEAAPVPREAPGVAAGGARPPLLHVAIREAEARPFEVLMQFLYTDKIKYPRKGHVEDVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTPLDQPVDIGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVSKLPTLRSLSQQLLLDIIDSLASHISDKQCAELGADI

SEQ ID NO: 10847 - protein, 520 aa, Human
PWLLSSLKRHFSETQSFSSAKMKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKNGNMAGISDQRIAIDLFKHQGTITVNEEGTQATTVTTVGFMPLSTQVRFTVDRPFLFLIYEHRTSCLLFMGRVANPSRS

SEQ ID NO: 10848 - protein, 282 aa, Human
GEALDGGGSGAPPSVSQTESRAGTMSAYPKSYNPFDDDGEDEGARPAPWRDARDLPDGPDAPADRQQYLRQEVLRRAEATAASTSRSLALMYESEKVGVASSEELARQRGVLERTEKMVDKMDQDLKISQKHINSIKSVFGGLVNYFKSKPVETPPEQNGTLTSQPNNRLKEAISTSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTERKVRQL

SEQ ID NO: 10849 - protein, 222 aa, Human
TSENCRHLRFPPRPSEVQPIMKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 10850 - protein, 773 aa, Human
QPTEEEASSKEDSAPSKPVVGIIYPPPEVRNIVDKTASFVARNGPEFEARIRQNEINNPKFNFLNPNDPYHAYYRHKVSEFKEGKAQEPSAAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 10851 - protein, 195 aa, Human
QPRMASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 10852 - protein, 1302 aa, Human
DRFYFRQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEVTSDGIFSPTAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 10853 - protein, 3838 aa, Human
EANQPKRKMAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQAIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 10854 - protein, 426 aa, Human
ALLRTSLSAPLIVGRIQCGKKLLQPSKQLRMFLKAVVLTLALVAVAGARAEVSADQVATVMWDYFSQLSNNAKEAVEHLQKSELTQQLNALFQDKLGEVNTYAGDLQKKLVPFATELHERLAKDSEKLKEEIGKELEELRARLLPHANEVSQKIGDNLRELQQRLEPYADQLRTQVNTQAEQLRRQLTPYAQRMERVLRENADSLQASLRPHADELKAKIDQNVEELKGRLTPYADEFKVKIDQTVEELRRSLAPYAQDTQEKLNHQLEGLTFQMKKNAEELKARISASAEELRQRLAPLAEDVRGNLRGNTEGLQKSLAELGGHLDQQVEEFRRRVEPYGENFNKALVQQMEQLRQKLGPHAGDVEGHLSFLEKDLRDKVNSFFSTFKEKESQDKTLSLPELEQQQEQQQEQQQEQVQMLAPLES

SEQ ID NO: 10855 - protein, 504 aa, Human
RHCSPSARSLRLFLGWWQLAEVTGEGWGRESGGSRKPRSELRVVAMAASGAVEPGPPGAAVAPSPAPAPPPAPDHLFRPISAEDEEQQPTEIESLCMNCYCNGMTRLLLTKIPFFREIIVSSFSCEHCGWNNTEIQSAGRIQDQGVRYTLSVRALEDMNREVVKTDSAATRIPELDFEIPAFSQKGALTTVEGLITRAISGLEQDQPARRANKDATAERIDEFIVKLKELKQVASPFTLIIDDPSGNSFVENPHAPQKDDALVITHYNRTRQQEEMLGLQEEAPAEKPEEEDLRNEVLQFSTNCPECNAPAQTNMKLVQIPHFKEVIIMATNCENCGHRTNEVKSGGAVEPLGTRITLHITDASDMTRDLLKSETCSVEIPELEFELGMAVLGGKFTTLEGLLKDIRELVTKNPFTLGDSSNPGQTERLQEFSQKMDQIIEGNMKAHFIMDDPAGNSYLQNVYAPEDDPEMKVERYKRTFDQNEELGLNDMKTEGYEAGLAPQR

SEQ ID NO: 10856 - protein, 380 aa, Human
ECWREELSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 10857 - protein, 2666 aa, Human
RAVPSPRLQHRPPGFSRLKMSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 10858 - protein, 545 aa, Human
MGRRGSAPGNGRTLRGCERGGRRRRSADSVMAEQVALSRTQVCGILREELFQGDAFHQSDTHIFIIMGASGDLAKKKIYPTIWWLFRDGLLPENTFIMGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 10859 - protein, 491 aa, Human [sequence omitted]

SEQ ID NO: 10860 - protein, 157 aa, Human
MQLTVKALQGRECSLQVPEDELVSTLKQLVSEKLNVPVRQQRLLFKGKALADGKRLSDYSIGPNSKLNLVVKPLEKVLLEEGEAQRLADSPPPQVWQLISKVLARHFSAADASRVLEQLQRDYERSLSRLTLDDIERLASRFLHPEVTETMEKGFSK

SEQ ID NO: 10861 - protein, 244 aa, Human
GGPRATGAESPAGRAGGALRRHGRGHEVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGN

SEQ ID NO: 10862 - protein, 288 aa, Human
EAAACCSAGTMELSYRLFICLLLWGSTELCYPQPLWLLQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMV

SEQ ID NO: 10863 - protein, 240 aa, Human
QTPPAKNTRLEEHKSAAEPSAPHFSEQTSRAESASMTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 10864 - protein, 692 aa, Human
LARCASSRSMALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 10865 - protein, 403 aa, Human
PLTLSYRKVSEDLCQMTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGTATFIMAFIPPLSVRFPAAAASKFLTIRSLLSFWLNLSTMGLRQYMSSPKCVPFG

SEQ ID NO: 10866 - protein, 147 aa, Human
AVKMLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 10867 - protein, 557 aa, Human
SPVRGRRRLGRELLGPAAVPVAASGSRPLGPPAAVMRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 10868 - protein, 336 aa, Human
GGGPQQPEAGSPGAQRYITRPPRQRRRAGSRQAAGAQTASPPPLAPPAPAPSPGGRPPSPAPAPRQPRCAPSRPAGHSEGSAPEAKVAPHGPAGERARAAAAPPAARTATLERRAAAPAAAAAAAMTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 10869 - protein, 332 aa, Human
GEPKMTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 10870 - protein, 1034 aa, Human
LARQGTARMGGSQSLQPAPASDLNLEASEAMSSDSEEAFETPESTTPVKAPPAPPPPPPEVIPEPEVSTQPPPEEPGCGSETVPVPDGPRSDSVEGSPFRPPSHSFSAVFDEDKPIASSGTYNLDFDNIELVDTFQTLEPRASDAKNQEGKVNTRRKSTDSVPISKSTLSRSLSLQASDFDGASSSGNPEAVALAPDAYSTGSSSASSTLKRTKKPRPPSLKKKQTTKKPTETPPVKETQQEPDEESLVPSGENLASETKTESAKTEGPSPALLEETPLEPAVGPKAACPLDSESAEGVVPPASGGGRVQNSPPVGRKTLPLTTAPEAGEVTPSDSGGQEDSPAKGLSVRLEFDYSEDKSSWDNQQENPPPTKKIGKKPVAKMPLRRPKMKKTPEKLDNTPASPPRSPAEPNDIPIAKGTYTFDIDKWDDPNFNPFSSTSKMQESPKLPQQSYNFDPDTCDESVDPFKTSSKTPSSPSKSPASFEIPASAMEANGVDGDGLNKPAKKKKTPLKTDTFRVKKSPKRSPLSDPPSQDPTPAATPETPPVISAVVHATDEEKLAVTNQKWTCMTVDLEADKQDYPQPSDLSTFVNETKFSSPTEELDYRNSYEIEYMEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEITAPEGSFASADALLSRLAHPVSLCGALDYLEPDLAEKNPPLFAQKLQEELEFAIMRIEALKLARQIALASRSHQDAKREAAHPTDVSISKTALYSRIGTAEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 10871 - protein, 306 aa, Human
QARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 10872 - protein, 1960 aa, Human [sequence omitted]

SEQ ID NO: 10873 - protein, 383 aa, Human
MSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTIDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 10874 - protein, 128 aa, Human
QPSLSVQAPALHPHPSCRMSMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVDEFSTLVAES

SEQ ID NO: 10875 - protein, 491 aa, Human
IGAARGWEAITYLALRKKTKASMHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 10876 - protein, 473 aa, Human
KFTMKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 10877 - protein, 484 aa, Human
TKKVRAVRMMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 10878 - protein, 613 aa, Human
SLFFPIHFIMNIVENSIFLSNLMKSANTFELKYDLSCELYRMSTYSTFPAGVPVSERSLARAGFYYTGVNDKVKCFCCGLMLDNWKRGDSPTEKHKKLYPSCRFVQSLNSVNNLEATSQPTFPSSVTNSTHSLLPGTENSGYFRGSYSNSPSNPVNSRANQDFSALMRSSYHCAMNNENARLLTFQTWPLTFLSPTDLAKAGFYYIGPGDRVACFACGGKLSNWEPKDNAMSEHLRHFPKCPFIENQLQDTSRYTVSNLSMQTHAARFKTFFNWPSSVLVNPEQLASAGFYYVGNSDDVKCFCCDGGLRCWESGDDPWVQHAKWFPRCEYLIRIKGQEFIRQVQASYPHLLEQLLSTSDSPGDENAESSIIHFEPGEDHSEDAIMMNTPVINAAVEMGFSRSLVKQTVQRKILATGENYRLVNDLVLDLLNAEDEIREEERERATEEKESNDLLLIRKNRMALFQHLTCVIPILDSLLTAGIINEQEHDVIKQKTQTSLQARELIDTILVKGNIAATVFRNSLQEAEAVLYEHLFVQQDIKYIPTEDVSDLPVEEQLRRLQEERTCKVCMDKEVSIVFIPCGHLVVCKDCAPSLRKCPICRSTIKGTVRTFLS

SEQ ID NO: 10879 - protein, 402 aa, Human
CCYIQQSELSISQKKSMFAEIQIQDKDRMGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 10880 - protein, 471 aa, Human
MSHHPSGLRAGFSSTSYRRTFGPPPSLSPGAFSYSSSSRFSSSRLLGSASPSSSVRLGSFRSPRAGAGALLRLPSERLDFSMAEALNQEFLATRSNEKQELQELNDRFANFIEKVRFLEQQNAALRGELSQARGQEPARADQLCQQELRELRRELELLGRERDRVQVERDGLAEDLAALKQRLEEETRKREDAEHNLVLFRKDVDDATLSRLELERKIESLMDEIEFLKKLHEEELRDLQVSVESQQVQQVEVEATVKPELTAALRDIRAQYESIAAKNLQEAEEWYKSKYADLSDAANRNHEALRQAKQEMNESRRQIQSLTCEVDGLRGTNEALLRQLRELEEQFALEAGGYQAGAARLEEELRQLKEEMARHLREYQELLNVKMALDIEIATYRKLLEGEESRISVPVHSFASLNIKTTVPEVEPPQDSHSRKTVLIKTIETRNGEQVVTESQKEQRSELDKSSAHSY

SEQ ID NO: 10881 - protein, 336 aa, Human
RAPLAMETVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 10882 - protein, 485 aa, Human
LSWRQDGELAVSPRPAPTGASASRMWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 10883 - protein, 667 aa, Human
AATMDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 10884 - protein, 634 aa, Human
AGEDVWRCPGCGDHIAPSQIWYRTVNETWHGSCFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRPAFSKLEDSFEALSLYLGELGIPLPAELEELDHTVSMQYGLTRDSPP

SEQ ID NO: 10885 - protein, 634 aa, Human; identical to SEQ ID NO: 10884

SEQ ID NO: 10886 - protein, 686 aa, Human
APVGICWGPSGLESSGSRSCSGGRGELRAACLQPEVPGAPGLSWWPSTAGLRQSQTDLQLSLSIWCGKKMGSYLSVPAYFTSRDLFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRPAFSKLEDSFEALSLYLGELGIPLPAELEELDHTVSMQYGLTRDSPP

SEQ ID NO: 10887 - protein, 686 aa, Human; identical to SEQ ID NO: 10886

SEQ ID NO: 10888 - protein, 641 aa, Human
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNREGQKCSHQDPIESSDSYGDLSDASDLKTPEKQSANGSFSCDMAVPKNKMESDGEKKYPCPECGSFFRSKSYLNKHIQKVHVRALGGPLGDLGPALGSPFSPQQNMSLLESFGFQIVQSAFASSLVDPEVDQQPMGPEGK

SEQ ID NO: 10889 - protein, 641 aa, Human; identical to SEQ ID NO: 10888

SEQ ID NO: 10890 - protein, 641 aa, Human; identical to SEQ ID NO: 10888

SEQ ID NO: 10891 - protein, 641 aa, Human; identical to SEQ ID NO: 10888

SEQ ID NO: 10892 - protein, 753 aa, Human
AWRFLSPLVCEVRKTRGAVMSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 10893 - protein, 278 aa, Human
MPASLALLQPRAMMKTLSSGNCTLSVPAKNSYRMVVLGASRVGKSSIVSRFLNGRFEDQYTPTIEDFHRKVYNIRGDMYQLDILDTSGNHPFPAMRRLSILTGDVFILVFSLDNRESFDEVKRLQKQILEVKSCLKNKTKEAAELPMVICGNKNDHGELCRQVPTTEAELLVSGDENCAYFEVSAKKNTNVDEMFYVLFSMAKLPHEMSPALHRKISVQYGDAFHPRPFCMRRVKEMDAYGMVSPFARRPSVNSDLKYIKAKVLREGQARERDKCTIQ

SEQ ID NO: 10894 - protein, 177 aa, Human
PQLLGPGHPVSPYLLFLSSSDCAMGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 10895 - protein, 345 aa, Human
AATGSQWPLPWTCLRSSSPCWSTLCLGQRREQARCASRVRGTMSDAGGGKKPPVDPQAGPGPGPGRAAGERGLSGSFPLVLKKLMENPPREARLDKEKGKEKLEEDEAAAASTMAVSASLMPPIWDKTIPYDGESFHLEYMDLDEFLLENGIPASPTHLAHNLLLPVAELEGKESASSSTASPPSSSTAIFQPSETVSSTESSLEKERETPSPIDPNCVEVDVNFNPDPADLVLSSVPGGELFNPRKHKFAEEDLKPQPMIKKAKKVFVPDEQKDEKYWTRRKKNNVAAKRSRDARRLKENQITIRAAFLEKENTALRTEVAELRKEVGKCKTIVSKYETKYGPL

SEQ ID NO: 10896 - protein, 568 aa, Human
PAGHLDRWIRRWRPRPDPDPKSVPAPEGGGARSIPPTRRRRLFTMASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLK

SEQ ID NO: 10897 - protein, 159 aa, Human
SVSLRCWAADRPNRHAWYPRGVRQETTKTDAMTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLKQQIQSIQQSIERLLV

SEQ ID NO: 10898 - protein, 786 aa, Human
SLSVHKMAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 10899 - protein, 450 aa, Human
PGSRDPSAFQTFLSFQSPTHTADTRRPDLVRSSEAESRAMLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEERAQGYPKMAAALNATGRPIAFSCSWPAYEGGLPPRVNYSLLADICNLWRNYDDIQDSWWSVLSILNWFVEHQDILQPVAGPGHWNDPDMLLIGNFGLSLEQSRAQMALWTVLAAPLLMSTDLRTISAQNMDILQNPLMIKINQDPLGIQGRRIHKEKSLIEVYMRPLSNKASALVFFSCRTDMPYRYHSSLGQLNFTGSVIYEAQDVYSGDIISGLRDETNFTVIINPSGVVMWYLYPIKNLEMSQQ

SEQ ID NO: 10900 - protein, 433 aa, Human
EFRLCLQPGTPSLPPSTMPYNFCLPSLSCRTSCSSRPCVPPSCHSCTLPGACNIPANVSNCNWFCEGSFNGSEKETMQFLNDRLASYLEKVRQLERDNAELENLIRERSQQQEPLLCPSYQSYFKTIEELQQKILCTKSENARLVVQIDNAKLAADDFRTKYQTELSLRQLVESDINGLRRILDELTLCKSDLEAQVESLKEELLCLKSNHEQEVNTLRCQLGDRLNVEVDAAPTVDLNRVLNETRSQYEALVETNRREVEQWFTTQTEELNKQVVSSSEQLQSYQAEIIELRRTVNALEIELQAQHNLRDSLENTLTESEARYSSQLSQVQSLITNVESQLAEIRSDLERQNQEYQVLLDVRARLECEINTYRSLLESEDCNLPSNPCATTNACSKPIGPCLSNPCTSCVPPAPCTPCAPRPRCGPCNSFVR

SEQ ID NO: 10901 - protein, 340 aa, Human
CERLPHAPPPLRTMFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 10902 - protein, 713 aa, Human
LRAGASATSDQTPAHLTPACRNRGATRGSGEGSEAAAATPSFPPSSSVRPSVRASVRSARSGPKHGRRQLQRHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEIHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGEPLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 10903 - protein, 643 aa, Human
WVPRMLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLTFLYLFVCSLDMLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHITRLVVASFNIHGGRDAPDLLKIITEPFTKLIIQLDESVITSIATGDESLRNHSLIQIWCHPDSLQAPTSMSRAEANSSQTLGNATMEKCNHIFVDTGLPDLAVGLILLAGSLVLLCTCLILLVKMLNSLLKGQVAKVIQKVINTDFPAPFTWVTGYFAMVVGASMTFVVQSSSVFTSAITPLIGLGVISIERAYPLTLGSNIGTTTTAILAALASPREKLSSAFQIALCHFFFNISGILLWYPVPCTRLPIRMAKALGKRTAKYRWFAVLYLLVCFLLLPSLVFGISMAGWQVMVGVGTPFGALLAFVVLINVLQSRSPGHLPKWLQTWDFLPRWMHSLKPLDHLITRATLCCARPEPRSPPLPPRVFLEELPPATPSPRLALPAHHNATRL

SEQ ID NO: 10904 - protein, 816 aa, Human
VGSPAWVPESCEKEMRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDLSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 10905 - protein, 934 aa, Human
PIGGHLPLWKLMDSIGSSGLRQGEETLSCSEEGLPGPSDSSELVQECLQQFKVTRAQLQQIQASLLGSMEQALRGQASPAPAVRMLPTYVGSTPHGTEQGDFVVLELGATGASLRVLWVTLTGIEGHRVEPRSQEFVIPQEVMLGAGQQLFDFAAHCLSEFLDAQPVNKQGLQLGFSFSFPCHQTGLDRSTLISWTKGFRCSGVEGQDVVQLLRDAIRRQGAYNIDVVAVVNDTVGTMMGCEPGVRPCEVGLVVDTGTNACYMEEARHVAVLDEDRGRVCVSVEWGSFSDDGALGPVLTTFDHTLDHESLNPGAQRFEKMIGGLYLGELVRLVLAHLARCGVLFGGCTSPALLSQGSILLEHVAEMEDPSTGAARVHAILQDLGLSPGASDVELVQHVCAAVCTRAAQLCAAALAAVLSCLQHSREQQTLQVAVATGGRVCERHPRFCSVLQGTVMLLAPECDVSLIPSVDGGGRGVAMVTAVAARLAAHRRLLEETLAPFRLNHDQLAAVQAQMRKAMAKGLRGEASSLRMLPTFVRATPDGSERGDFLALDLGGTNFRVLLVRVTTGVQITSEIYSIPETVAQGSGQQLFDHIVDCIVDFQQKQGLSGQSLPLGFTFSFPCRQLGLDQGILLNWTKGFKASDCEGQDVVSLLREAITRRQAVELNVVAIVNDTVGTMMSCGYEDPRCEIGLIVGTGTNACYMEELRNVAGVPGDSGRMCINMEWGAFGDDGSLAMLSTRFDASVDQASINPGKQRFEKMISGMYLGEIVRHILLHLTSLGVLFRGQQIQRLQTRDIFKTKFLSEIESDSLALRQVRAILEDLGLPLTSDDALMVLEVCQAVSQRAAQLCGAGVAAVVEKIRENRGLEELAVSVGVDGTLYKLHPRFSSLVAATVRELAPRCVVTFLQSEDGSGKGAALVTAVACRLAQLTRV

SEQ ID NO: 10906 - protein, 355 aa, Human
ALSPVNIDRQAWLGEEVLAEPRPDMFRAQQLQIFNLMKFDSYARFVKSPLYRECLLAEAEGRPLREPGSSRLGSPDATRKKPKLKPGKSLPLGVEELGQLPPVEGPGGRPLRKSFRRELGGTANAALRRESQGSLNSSASLDLGFLAFVSSKSESHRKSLGSTEGESESRPGKYCCVYLPDGTASLALARPGLTIRDMLAGICEKRGLSLPDIKVYLVGNEQKALVLDQDCTVLADQEVRLENRITFELELTALERVVRISAKPTKRLQEALQPILEKHGLSPLEVVLHRPGEKQPLDLGKLVSSVAAQKTGFGHSSRCEDLQSPCTNLPAAARAAHLELRIRPPIPLQRPPVLW

SEQ ID NO: 10907 - protein, 194 aa, Human
NISRFIDFFFSLSPSHSHARSHFLFAIMNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 10908 - protein, 330 aa, Human
RVTAGMKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCFVSFFDLRDPSQIDNNEPYMKIPCNDSKITSAVWGPLGECIIAGHESGELNQYSAKSGEVLVNVKEHSRQINDIQLSRDMTMFVTASKDNTAKLFDSTTLEHQKTFRTERPVNSAALSPNYDHVVLGGGQEAMDVTTTSTRIGKFEARFFHLAFEEEFGRVKGHFGPINSVAFHPDGKSYSSGGEDGYVRIHYFDPQYFEFEFEA

SEQ ID NO: 10909 - protein, 465 aa, Human
DVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPGVQMQAIPEDAIPEESGDEDEDDPDKRISICSSDKRIACEEEFSDSEEEGEGGRKNSSNFKKAKRVKTEDEKEKDPEEKKEVTEEEKTKEEKPEAKGVKEEVKLA

SEQ ID NO: 10910 - protein, 1609 aa, Human
PLWTGMWVSWAPGLWLLGLWATFGHGANTGAQCPPSQQEGLKLEHSSSLPANVTGFNLIHRLSLMKKSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGAPGLWMGSSWQPGPQGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 10911 - protein, 242 aa, Human [sequence omitted]

SEQ ID NO: 10912 - protein, 337 aa, Human
ASDSAGPGMADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTGPGISCPPIPAPAATPGTVTPQPPPPRAAPLVPAVMTQALAPGGSDPAGG

SEQ ID NO: 10913 - protein, 296 aa, Human
APLRLCSLSSFGTRPSRSRARHLSAHSAVCLPSRRQLLPRACPLRSRCSEGRREARRGRGAPGRARGAHGLGAHGAAPAHEAFQRGERQRRPAMGGSLRVAVLGAPGVGKTAIIRQFLFGDYPERHRPTDGPRLYRPAVLLDGAVYDLSIRDGDVAGPGSSPGGPEEWPDAKDWSLQDTDAFVLVYDICSPDSFDYVKALRQRIAETRPAGAPEAPILVVGNKRDRQRLRFGPRRALAALVRRGWRCGYLECSAKYNWHVLRLFRELLRCALVRARPAHPALRLQGALHPARCSLM

SEQ ID NO: 10914 - protein, 591 aa, Human
ENEEEGEKMASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQRPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 10915 - protein, 591 aa, Human; identical to SEQ ID NO: 10914

SEQ ID NO: 10916 - protein, 1203 aa, Human
SGPLVMDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVTSIPDSESNLDQNCLSRCSTEIFSEASWEQVDKQDTEMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 10917 - protein, 108 aa, Human
RPQAAECSSGAARGKRELIKFFVPGEFTSLPPSWKMQVKGNASNHLVRALEKARSSAQLQTNYPSSDNSLYTNAKGSTISAFDGGSDSSSESEPEEPQSRKKLRMEAS

SEQ ID NO: 10918 - protein, 2141 aa, Human
EPADMTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWDALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKALEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPVSLWSRLSSSWESLQPEPSHPY

SEQ ID NO: 10919 - protein, 443 aa, Human
SAALLIMASPSSFTYYCPPSSSPVWSEPLYSLRPEHARERLQDDSVETVTSIEQAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 10920 - protein, 417 aa, Human
AMELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 10921 - protein, 349 aa, Human
LFFCCPLFNMKEDQVVAEEPGFQDEEESLFQDIDLLQKHGINVADIKKLKSVGICTIKGIQMTTRRALCNVKGLSEAKVDKIKEAANKLIEPGFLTAFEYSEKRKMVFHITTGSQEFDKLLGGGIESMAITEAFGEFRTGKTQLSHTLCVTAQLPGAGGYPGGKIIFIDTENTFRPDRLRDIADRFNVDHDAVLDNVLYARAYTSEHQMELLDYVAAKFHEEAGIFKLLIIDSIMALFRVDFSGRGELAERQQKLAQMLSRLQKISEEYNVAVFVTNQMTADPGATMTFQADPKKPIGGHILAHASTTRISLRKGRGELRIAKIYDSPEMPENEATFAITAGGIGDAKE

SEQ ID NO: 10922 - protein, 635 aa, Human
AARLHGGFDSDCSEDGEALNGEPELDLTSKLVLVSPTSEQYDSLLRQMWERMDEGCGETIYVIGQGSDGTEYGLSEADMEASYATVKSMAEQIEADVILLRERQEAGGRVRDYLVRKRVGDNDFLEVRVAVVGNVDAGKSTLLGVLTHGELDNGRGFARQKLFRHKHEIESGRTSSVGNDILGFDSEGNVVNKPDSHGGSLEWTKICEKSTKVITFIDLAGHEKYLKTTVFGMTGHLPDFCMLMVGSNAGIVGMTKEHLGLALALNVPVFVVVTKIDMCPANILQETLKLLQRLLKSPGCRKIPVLVQSKDDVIVTASNFSSERMCPIFQISNVTGENLDLLKMFLNLLSPRTSYREEEPAEFQIDDTYSVPGVGTVVSGTTLRGLIKLNDTLLLGPDPLGNFLSIAVKSIHRKRMPVKEVRGGQTASFALKKIKRSSIRKGMVMVSPRLNPQASWEFEAEILVLHHPTTISPRYQAMVHCGSIRQTATILSMDKDCLRTGDKATVHFRFIKTPEYLHIDQRLVFREGRTKAVGTITKLLQTTNNSPMNSKPQQIKMQSTKKGPLTKRDEGGPSGGPAVGAPPPGDEASSVGAGQPAASSNLQPQPKPSSGGRRRGGQRHKVKSQGACVTPASGC

SEQ ID NO: 10923 - protein, 362 aa, Human
AHSSIPAKHRNMTEMSFLSSEVLVGDLMSPFDQSGLGAEESLGLLDDYLEVAKHFKPHGFSSDKAKAGSSEWLAVDGLVSPSNNSKEDAFSGTDWMLEKMDLKEFDLDALLGIDDLETMPDDLLTTLDDTCDLFAPLVQETNKQPPQTVNPIGHLPESLTKPDQVAPFTFLQPLPLSPGVLSSTPDHSFSLELGSEVDITEGDRKPDYTAYVAMIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 10924 - protein, 338 aa, Human
SLPASRYSMEAVAKFDFTASGEDELSFHTGDVLKILSNQEEWFKAELGSQEGYVPKNFIDIQFPKWFHEGLSRHQAENLLMGKEVGFFIIRASQSSPGDFSISVRHEDDVQHFKVMRDNKGNYFLWTEKFPSLNKLVDYYRTNSISRQKQIFLRDRTREDQGHRGNSLDRRSQGGPHLSGAVGEEIRPSMNRKLSDHPPTLPLQQHQHQPQPPQYAPAPQQLQQPPQQRYLQHHHFHQERRGGSLDINDGHCGTGLGSEMNAALMHRRHTDPVQLQAAGRVRWARALYDFEALEDDELGFHSGEVVEVLDSSNPSWWTGRLHNKLGLFPANYVAPMTR

SEQ ID NO: 10925 - protein, 1344 aa, Human
LVTMWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPPVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRALHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 10926 - protein, 155 aa, Human
GLVTIFGCPSREKGRMPLESSSSMPLSFPSLLPSVPHNTNPSPPLMSYITSQEMKCILHWFANWSGPQRERFLEDLVAKAVPEKLQPLLDSLEQLSVSGADRPPSIFECQLHLWDQWFRGWAEQERNEFVRQLEFSEPDFVAKFYQAVAATAGKD

SEQ ID NO: 10927 - protein, 263 aa, Human
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 10928 - protein, 193 aa, Human
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETRLADWIHSSGGWAEFTALYGDGALEEARRLREGNWASVRTVLTGAVALGALVTVGAFFASK

SEQ ID NO: 10929 - protein, 1944 aa, Human
THLSSPGTAMGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLFDNHLGKSANFQKPRNIKGKPEAHFSLIHYAGIVDYNIIGWLQKNKDPLNETVVGLYQKSSLKLLSTLFANYAGADAPIEKGKGKAKKGSSFQTVSALHRENLNKLMTNLRSTHPHFVRCIIPNETKSPGVMDNPLVMHQLRCNGVLEGIRICRKGFPNRILYGDFRQRYRILNPAAIPEGQFIDSRKGAEKLLSSLDIDHNQYKFGHTKVFFKAGLLGLLEEMRDERLSRIITRIQAQSRGVLARMEYKKLLERRDSLLVIQWNIRAFMGVKNWPWMKLYFKIKPLLKSAEREKEMASMKEEFTRLKEALEKSEARRKELEEKMVSLLQEKNDLQLQVQAEQDNLADAEERCDQLIKNKIQLEAKVKEMNERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 10930 - protein, 449 aa, Human
ACGAMERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 10931 - protein, 740 aa, Human
ARRGGCGAGAGGQGRVAQEVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKAISVKTRRSRTVKAETEGKGDAATGTGTNETAGRQPHSTSSDRAQEKEESGLSGAGLRSRGVGPRLSGPRQLGCRNPQTVHATKNHAGQPQGPHILFRK

SEQ ID NO: 10932 - protein, 3647 aa, Human
PAGLPPRALSLELGDAARSREDGEAALRGERTGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIGHTGVTAYCPQIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTAGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEGDSCESQAQVPCMCRAHVEGPSCDRCKPGFWGLSPSNPEGCTRECALEYWGCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSAACANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPATSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPEGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVSLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSTPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRRRRAGRDAPWGGLRGEEGGLLGVPRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQVLSVLAFPPQPGPVQAFTFRLPQSQLRSPLGPHHETAQQLEAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPLPWALIPARSAPIGDRRVQRLCEETEAAREAPGGPHTDGRDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 10933 - protein, 3913 aa, Human
RGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKETESDQDDEIEKTDRRQSFASLALRKRYSYLTEPGMIERSTGATRSLPTTYSYKPFFSTRPYQSWTTAPITVPGPAKSGFTSLSSSSSNTPSASPLKSIWSVSTPSPIKSTLGASTTSSVKSISDVASPIRSFRTMSSPIKTVVSQSPYNIQVSSGTLARAPAVTEATPLKGLASNSTFSSRTSPVTTAGSLLERSSITMTPPASPKSNINMYSSSLPFKSIITSAAPLISSPLKSVVSPVKSAVDVISSAKITMASSLSSPVKQMPGHAEVALVNGSISPLKYPSSSTLINGCKATATLQEKISSATNSVSSVVSAATDTVEKVFSTTTAMPFSPLRSYVSAAPSAFQSLRTPSASALYTSLGSSISATTSSVTSSIITVPVYSVVNVLPEPALKKLPDSNSFTKSAAALLSPIKTLTTETHPQPHFSRTSSPVKSSLFLAPSALKLSTPSSLSSSQEILKDVAEMKEDLMRMTAILQTDVPEEKPFQPELPKEGRIDDEEPFKIVEKVKEDLVKVSEILKKDVCVDNKGSPKSPKSDKGHSPEDDWIEFSSEEIREARQQAAASQSPSLPERVQVKAKAASEKDYNLTKVIDYLTNDIGSSSLTNLKYKFEDAKKDGEERQKRVLKPAIALQEHKLKMPPASMRTSTSEKELCKMADSFFGTDTILESPDDFSQHDQDKSPLSDSGFETRSEKTPSAPQSAESTGPKPLFHEVPIPPVITETRTEVVHVIRSYDPSAGDVPQTQPEEPVSPKPSPTFMELEPKPTTSSIKEKVKAFQMKASSEEDDHNRVLSKGMRVKEETHITTTTRMVYHSPPGGEGASERIEETMSVHDIMKAFQSGRDPSKELAGLFEHKSAVSPDVHKSAAETSAQHAEKDNQMKPKLERIIEVHIEKGNQAEPTEVIIRETKKHPEKEMYVYQKDLSRGDINLKDFLPEKHDAFPCSEEQGQQEEEELTAEESLPSYLESSRVNTPVSQEEDSRPSSAQLISDDSYKTLKLLSQHSIEYHDDELSELRGESYRFAEKMLLSEKLDVSHSDTEESVTDHAGPPSSELQGSDKRSREKIATAPKKEILSKIYKDVSENGVGKVSKDEHFDKVTVLHYSGNVSSPKHAMWMRFTEDRLDRGREKLIYEDRVDRTVKEAEEKLTEVSQFFRDKTEKLNDELQSPEKKARPKNGKEYSSQSPTSSSPEKVLLTELLASNDEWVKARQHGPDGQGFPKAEEKAPSLPSSPEKMVLSQQTEDSKSTVEAKGSISQSKAPDGPQSGFQLKQSKLSSIRLKFEQGTHAKSKDMSQEDRKSDGQSRIPVKKIQESKLPVYQVFAREKQQKAIDLPDESVSVQKDFMVLKTKDEHAQSNEIVVNDSGSDNVKKQRTEMSSKAMPDSFSEQQAKDLACHITSDLATRGPWDKKVFRTWESSGATNNKSQKEKLSHVLVHDVRENHIGHPESKSVDQKNEFMSVTERERKLLTNGSLSEIKEMTVKSPSKKVLYREYVVKEGDHPGGLLDQPSRRSESSAVSHIPVRVADERRMLSSNIPDGFCEQSAFPKHELSQKLSQSSMSKETVETQHFNSIEDEKVTYSEISKVSKHQSYVGLCPPLEETETSPTKSPDSLEFSPGKESPSSDVFDHSPIDGLEKLAPLAQTEGGKEIKTLPVYVSFVQVGKQYEKEIQQGGVKKIISQECKTVQETRGTFYTTRQQKQPPSPQGSPEDDTLEQVSFLDSSGKSPLTPETPSSEEVSYEFTSKTPDSLIAYIPGKPSPIPEVSEESEEEEQAKSTSLKQTTVEETAVEREMPNDVSKDSNQRPKNNRVAYIEFPPPPPLDADQIESDKKHHYLPEKEVDMIEVNLQDEHDKYQLAEPVIRVQPPSPVPPGADVSDSSDDESIYQPVPVKKYTFKLKEVDDEQKEKPKASAEKASNQKELESNGSGKDNEFGLGLDSPQNEIAQNGNNDQSITECSIATTAEFSHDTDATEIDSLDGYDLQDEDDGLTESDSKLPIQAMEIKKDIWNTEGILKPADRSFSQSKLEVIEEEGKVGPDEDKPPSKSSSSEKTPDKTDQKSGAQFFTLEGRHPDRSVFPDTYFSYKVDEEFATPFKTVATKGLDFDPWSNNRGDDEVFDSKSREDETKPFGLAVEDRSPATTPDTTPARTPTDESTPTSEPNPFPFHEGKMFEMTRSGAIDMSKRDFVEERLQFFQIGEHTSEGKSGDQGEGDKSMVTATPQPQSGDTTVETNLERNVETPTVEPNPSIPTSGECQEGTSSSGSLEKSAAATNTSKVDPKLRTPIKMGISASTMTMKKEGPGEITDKIEAVMTSCQGLENETITMISNTANSQMGVRPHEKHDFQKDNFNNNNNLDSSTIQTDNIMSNIVLTEHSAPTCTTEKDNPVKVSSGKKTGVLQGHCVRDKQKVLGEQQKTKELIGIRQKSKLPIKATSPKDTFPPNHMSNTKASKMKQVSQSEKTKALTTSSCVDVKSRIPVKNTHRDNIIAVRKACATQKQGQPEKGKAKQLPSKLPVKVRSTCVTTTTTTATTTTTTTTTTTTSCTVKVRKSQLKEVCKHSIEYFKGISGETLKLVDRLSEEEKKMQSELSDEEESTSRNTSLSETSRGGQPSVTTKSARDKKTEAAPLKSKSEKAGSEKRSSRRTGPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 10934 - protein, 280 aa, Human
PRTGASSGWKPGARPEVPRTQPAQTLGEMTPLCPRPALCYHFLTSLLRSAMQNARGARQRAEAAVLSGPGPPLGRAAQHGIPRPLSSAGRLSQGCRGASTVGAAGWKGELPKAGGSPAPGPETPAISPSKRARPAEVGGMQLRFARLSEHATAPTRGSARAAGYDLYSAYDYTIPPMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGFGSTGKN

SEQ ID NO: 10935 - protein, 246 aa, Human
PAKMSDMEDDFMCDDEEDYDLEYSEDSNSEPNVDLENQYYNSKALKEDDPKAALSSFQKVLELEGEKGEWGFKALKQMIKINFKLTNFPEMMNRYKQLLTYIRSAVTRNYSEKSINSILDYISTSKQMDLLQEFYETTLEALKDAKNDRLWFKTNTKLGKLYLEREEYGKLQKILRQLHQSCQTDDGEDDLKKGTQLLEIYALEIQMYTAQKNNKKLKALYEQSLHIKSAIPHPLIMGVIRGKMWW

SEQ ID NO: 10936 - protein, 469 aa, Human
EMVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPPFVIHDMETLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAAIICCGDRPGLLNVGHIEKMQEGIVHVLRLHLQSNHPDDIFLFPKLLQKMADLRQLVTEHAQLVQIIKKTESDAALHPLLQEIYRDMY

SEQ ID NO: 10937 - protein, 237 aa, Human
SEDLAKQLASYKAQLQQVEAALSGNGENEDLLKLKKDLQEVIELTKDLLSTQPSETLASSDSFASTQPTHSWKVGDKCMAVWSEDGQCYEAEIEEIDEENGTAAITFAGYGNAEVTPLLNLKPVEEGRKAKEDSGNKPMSKKEMIAQQREYKKKKALKKAQRIKELEQEREDQKVKWQQFNNRAYSKNKKGQVKRSIFASPESVTGKVGVGTCGIADKPMTQYQDTSKYNVRHLMPQ

SEQ ID NO: 10938 - protein, 204 aa, Human
ECEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 10939 - protein, 210 aa, Human
IQGGPVEILPFLYLGSAYHASKCEFLANLHITALLNVSRRTSEACMTHLHYKWIPVEDSHTADISSHFQEAIDFIDCVREKGGKVLVHCEAGISRSPTICMAYLMKTKQFRLKEAFDYIKQRRSMVSPNFGFMGQLLQYESEILPSTPNPQPPSCQGEAAGSSLIGHLQTLSPDMQGAYCTFPASVLAPVPTHSTVSELSRSPVATATSC

SEQ ID NO: 10940 - protein, 541 aa, Human
DRQVPDRGAQSTEWTRRGARSPDRGTAGRDGAMSGRGAGGFPLPPLSPGGGAVAAALGAPPPPAGPGMLPGPALRGPGPAGGRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 10941 - protein, 406 aa, Human
MALDGPEQMELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAREHAPSIIFMDEIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 10942 - protein, 624 aa, Human
EQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 10943 - protein, 260 aa, Human
RGQAAAGAVTRFPPRSLGRCHGFGVGDRAVTMARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 10944 - protein, 260 aa, Human; identical to SEQ ID NO: 10943

SEQ ID NO: 10945 - protein, 149 aa, Human
QLVRLPGNILLDSIMACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 10946 - protein, 140 aa, Human
ELPPGAVTMTGELEVKNMDMKPGSTLKITGSIADGTDGFVINLGQGTDKLNLHFNPRFSESTIVCNSLDGSNWGQEQREDHLCFSPGSEVKFTVTFESDKFKVKLPDGHELTFPNRLGHSHLSYLSVRGGFNMSSFKLKE

SEQ ID NO: 10947 - protein, 505 aa, Human
TSPRLEERSEEVGVGLFARTPAAGPGEAAEAAAAAAGGDMAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 10948 - protein, 819 aa, Human
GEDGGASPPAPQKMQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 10949 - protein, 490 aa, Human
ARWNGRWVQVPAWPGPGCGTNASGERQRQLPRAWRPVGRTLGSEPIALAWSPPLYLFPIPLPSWAVSQPTPTLGTMFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIKPMLTDLNTYLNKAIPDTRLTIKKYLDVKFEYLSYCLKVKEMDDEEYSCIALGEPLYRVSTGNYEYRLILRCRQEARARFSQMRKDVLEKMELLDQKHVQDIVFQLQRLVSTMSKYYNDCYAVLRDADVFPIEVDLAHTTLAYGLNQEEFTDGEEEEEEEDTAAGEPSRDTRGAAGPLDKGGSWCDS

SEQ ID NO: 10950 - protein, 654 aa, Human
CPGVPPPLPGAAATMFSCVKPYEDQNYSALRRDCRRRKVLFEDPLFPATDDSLYYKGTPGPAVRWKRPKGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 10951 - protein, 551 aa, Human
LLLVVTMSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQHQFLKIAKPLSSLTPLIAAAKEATKNNH

SEQ ID NO: 10952 - protein, 567 aa, Human
TGTKVNLKMPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQKQKNLDRPHEPEKVPRAPHDRRREWQKLAQGPELAEDDANLLHKHIEVANGPASHFETRPQTYVDHMDGSYSLSALPFSQMSELLTRAEERVLVRPHEPPPPPPMHGAGDAKPIPTCISSATGLIENRPQSPATGRTPVFVSPTPPPPPPPLPSALSTSSLRASMTSTPPPPVPPPPPPPATALQAPAVPPPPAPLQIAPGVLHPAPPPIAPPLVQPSPPVARAAPVCETVPVHPLPQGEVQGLPPPPPPPPLPPPGIRPSSPVTVTALAHPPSGLHPTPSTAPGPHVPLMPPSPPSQVIPASEPKRHPSTLPVISDARSVLLEAIRKGIQLRKVEEQREQEAKHERIENDVATILSRRIAVEYSDSEDDSEFDEVDWLE

SEQ ID NO: 10953 - protein, 446 aa, Human
VYFAAPSAFEKMSVTYDDSVGVEVSSDSFWEVGNYKRTVKRIDDGHRLCSDLMNCLHERARIEKAYAQQLTEWARRWRQLVEKGPQYGTVEKAWMAFMSEAERVSELHLEVKASLMNDDFEKIKNWQKEAFHKQMMGGFKETKEAEDGFRKAQKPWAKKLKEVEAAKKAHHAACKEEKLAISREANSKADPSLNPEQLKKLQDKIEKCKQDVLKTKEKYEKSLKELDQGTPQYMENMEQVFEQCQQFEEKRLRFFREVLLEVQKHLDLSNVAGYKAIYHDLEQSIRAADAVEDLRWFRANHGPGMAMNWPQFEEWSADLNRTLSRREKKKATDGVTLTGINQTGDQSLPSKPSSTLNVPSNPAQSAQSQSSYNPFEDEDDTGSTVSEKDDTKAKNVSSYEKTQSYPTDWSDNESNNPFSSTDANGDSNPFDDDATSGNGSAIPGPV

SEQ ID NO: 10954 - protein, 259 aa, Human
RNNSAFMTSSDFAERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 10955 - protein, 344 aa, Human
LLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRIVGSATRYLQVLCMSVAAEMDLEDGGEMPKQRDPKSN

SEQ ID NO: 10956 - protein, 637 aa, Human
MAAMAVGGAGGSRVSSGRDLNCVPEIADTLGAVAKQGFDFLCMPVFHPRFKREFIQEPAKNRPGPQTRSDLLLSGRDWNTLIVGKLSPWIRPDSKVEKIRRNSEAAMLQELNFGAYLGLPAFLLPLNQEDNTNLARVLTNHIHTGHHSSMFWMRVPLVAPEDLRDDIIENAPTTHTEEYSGEEKTWMWWHNFRTLCDYSKRIAVALEIGADLPSNHVIDRWLGEPIKAAILPTSIFLTNKKGFPVLSKMHQRLIFRLLKLEVQFIITGTNHHSEKEFCSYLQYLEYLSQNRPPPNAYELFAKGYEDYLQSPLQPLMDNLESQTYEVFEKDPIKYSQYQQAIYKCLLDRVPEEEKDTNVQVLMVLGAGRGPLVNASLRAAKQADRRIKLYAVEKNPNAVVTLENWQFEEWGSQVTVVSSDMREWVAPEKADIIVSELLGSFADNELSPECLDGAQHFLKDDGVSIPGEYTSFLAPISSSKLYNEVRACREKDRDPEAQFEMPYVVRLHNFHQLSAPQPCFTFSHPNRDPMIDNNRYCTLEFPVEVNTVLHGFAGYFETVLYQDITLSIRPETHSPGMFSWFPILFPIKQPITVREGQTICVRFWRCSNSKKVWYEWAVTAPVCSAIHNPTGRSYTIGL

SEQ ID NO: 10957 - protein, 738 aa, Human
ETMAGSSTGGGGVGETKVIYHLDEEETPYLVKIPVPAERITLGDFKSVLQRPAGAKYFFKSMDQDFGVVKEEISDDNARLPCFNGRVVSWLVSSDNPQPEMAPPVHEPRAELAPPAPPLPPLPPERTSGIGDSRPPSFHPNVSSSHENLEPETETESVVSLRRERPRRRDSSEHGAGGHRTGGPSRLERHLAGYESSSTLMTSELESTSLGDSDEEDTMSRFSSSTEQSSASRLLKRHRRRRKQRPPRLERTSSFSSVTDSTMSLNIITVTLNMEKYNFLGISIVGQSNERGDGGIYIGSIMKGGAVAADGRIEPGDMLLQVNDMNFENMSNDDAVRVLRDIVHKPGPIVLTVAKCWDPSPQAYFTLPRNEPIQPIDPAAWVSHSAALTGTFPAYPGSSSMSTITSGSSLPDGCEGRGLSVHTDMASVTKAMAAPESGLEVRDRMWLKITIPNAFLGSDVVDWLYHHVEGFPERREARKYASGLLKAGLIRHTVNKITFSEQCYYVFGDLSGGCESYLVNLSLNDNDGSSGASDQDTLAPLPGATPWPLLPTFSYQYPAPHPYSPQPPPYHELSSYTYGGGSASSQHSEGSRSSGSTRSDGGAGRTGRPEERAPESKSGSGSESEPSSRGGSLRRGGEASGTSDGGPPPSRGSTGGAPNLRAHPGLHPYGPPPGMALPYNPMMVVMMPPPPPPVPPAVQPPGAPPVRDLGSVPPELTASRQSFHMAMGNPSEFFVDVM

SEQ ID NO: 10958 - protein, 161 aa, Human
LESKPLKMADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAK

SEQ ID NO: 10959 - protein, 356 aa, Human
RKRREGGPRLRSGSQRQPGAHGPSAHGSTMPALLERPKLSNAMARALHRHIMMERERKRQEEEEVDKMMEQKMKEEQERRKKKEMEERMSLEETKEQILKLEEKLLALQEEKHQLFLQLKKVLHEEEKRRRKEQSDLTTLTSAAYQQSLTVHTGTHLLSMQGSPGGHNRPGTLMAADRAKQMFGPQVLTTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 10960 - protein, 356 aa, Human; identical to SEQ ID NO: 10959

SEQ ID NO: 10961 - protein, 238 aa, Human
GFSQPMALPGSSQDQAWSLEPPAATAAASSSSGPQEREGAGSPAAPGTLPLEKVKRPMNAFMVWSSAQRRQMAQQNPKMHNSEISKRLGAQWKLLDEDEKRPFVEEAKRLRARHLRDYPDYKYRPRRKAKSSGAGPSRCGQGRGNLASGGPLWGPGYATTQPSRGFGYRPPSYSTAYLPGSYGSSHCKLEAPSPCSLPQSDPRLQGELLPTYTHYLPPGSPTPYNPPLAGAPMPLTHL

SEQ ID NO: 10962 - protein, 250 aa, Human
LCNMAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 10963 - protein, 302 aa, Human
PAPRPDSPRATKMVIQKEKKSCGQVVEEWKEFVWNPRTHQFMGRTGTSWAFILLFYLVFYGFLTAMFTLTMWVMLQTVSDHTPKYQDRLATPGLMIRPKTENLDVIVNVSDTESWDQHVQKLNKFLEPYNDSIQAQKNDVCRPGRYYEQPDNGVLNYPKRACQFNRTQLGNCSGIGDSTHYGYSTGQPCVFIKMNRVINFYAGANQSMNVTCAGKRDEDAENLGNFVMFPANGNIDLMYFPYYGKKFHVNYTQPLVAVKFLNVTPNVEVNVECRINAANIATDDERDKFAGRVAFKLRINKT

SEQ ID NO: 10964 - protein, 746 aa, Human
VAETKAAAADGERPGPGPLLVGCGRAAVGPARLPPPAAPPPAPPPGRRRGPGPARTQTAAAAAAGGVGGGGGAMGGLASGGDVEPGLPVEVRGSNGAFYKGFVKDVHEDSVTIFFENNWQSERQIPFGDVRLPPPADYNKEITEGDEVEVYSRANEQEPCGWWLARVRMMKGDFYVIEYAACDATYNEIVTLERLRPVNPNPLATKGSFFKVTMAVPEDLREACSNENVHKEFKKALGANCIFLNITNSELFILSTTEAPVKRASLLGDMHFRSLRTKLLLMSRNEEATKHLETSKQLAAAFQEEFTVREDLMGLAIGTHGANIQQARKVPGVTAIELGEETCTFRIYGETPEACRQARSYLEFSEDSVQVPRNLVGKVIGKNGKVIQEIVDKSGVVRVRVEGDNDKKNPREEGMVPFIFVGTRENISNAQALLEYHLSYLQEVEQLRLERLQIDEQLRQIGLGFRPPGSGRGSGGSDKAGYSTDESSSSSLHATRTYGGSYGGRGRGRRTGGPAYGPSSDVSTASETESEKREEPNRAGPGDRDPPTRGEESRRRPTGGRGRGPPPAPRPTSRYNSSSISSVLKDPDSNPYSLLDTSEPEPPVDSEPGEPPPASARRRRSRRRRTDEDRTVMDGGLESDGPNMTENGLEDESRPQRRNRSRRRRNRGNRTDGSISGDRQPVTVADYISRAESQSRQRPPLERTKPSEDSLSGQKGDSVSKLPKGPSENGELSAPLELGSMVNGVS

SEQ ID NO: 10965 - protein, 428 aa, Human
LLGSGDTLRSGWERAFHDGDTLPWIGSQTAFRVTAMEEPQSDPSVEPPLSQETFSDLWKLLPENNVLSPLPSQAMDDLMLSPDDIEQWFTEDPGPDEAPRMPEAAPRVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 10966 - protein, 225 aa, Human
MAALASSLIRQKREVREPGGSRPVSAQRRVCPRGTKSLCQKQLLILLSKVRLCGGRPARPDRGPEPQLKGIVTKLFCRQGFYLQANPDGSIQGTPEDTSSFTHFNLIPVGLRVVTIQSAKLGHYMAMNAEGLLYSSPHFTAECRFKECVFENYYVLYASALYRQRRSGRAWYLGLDKEGQVMKGNRVKKTKAAAHFLPKLLEVAMYQEPSLHSVPEASPSSPPAP

SEQ ID NO: 10967 - protein, 397 aa, Human
ALCRGGAGTAGSRSAWALGASATGVVRAEEPGSQGSHPGGWATLGELVPRPPGLGGVMGPPHSGPGGVRVGALLLLGVLGLVSGLSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMPAVAGAAGGLALLLLGVAGAGGAMCWRRRRAKPSESRHPGPGSFGRGGSLGLGGGGGMGPREAEPGELGIALRGGGAADPPFCPHYEKVSGDYGHPVYIVQDGPPQSPPNIYYKV

SEQ ID NO: 10968 - protein, 876 aa, Human
MPAVNSWSGSIEIGVTALDPSVLDFPSSATGLKGGSWVVSGCSVLRDGRSVLEEYGQDLDQLGEGDRVGVERTVAGELRLWVNGRDCGVAATGLPPRVWAVVDLYGKCTQITVLPPEPGFSPPTPIPTPPLEPLAPTEDSALAEQGTSADEAFMVSPAQARPETFPNSLESHNDFANMELSEVVSNTILSAYNGGLLNVNLSSPPAGEGLGSSGAATSPILTSNDALLFHEKCGTLIKLSNNNKTAERRRPLDEFNNGVVMTNRPLRDNEMFEIRIDKLVDKWSGSIEIGVTTHNPNSLEYPATMTNLQSGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQVRIDKMVDKWAGSIEIGVTTHNPAYLQLPSTMTNLRSGTWMMTGNGVMHNGTTILDEYGHNLDRLKAGDTVGVVRREDGTLHFFVNGMTQGPAAWNVPPGVYAVVDLYGQAAQATIVDDVGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPGKEVYAVVDLYGQCVQVSITNATGPMDNSLATSNTATEKSFPLHSPVAGVAHRFHSTCGKNVTLEEDGTRAVRAAGYAHGLVFSTKELRAEEVFEVGSRVGVRRGADDTMHILVDGEDMGPAATGIAK

SEQ ID NO: 10969 - protein, 876 aa, Human; identical to SEQ ID NO: 10968

SEQ ID NO: 10970 - protein, 1935 aa, Human
VIVETFSCVMKAADTVILWARSKNDQLRISFPPGLCWGDRMPDKDDIRLLPSALGVKKRKRGPKKQKENKPGKPRKRKKRDSEEEFGSERDEYREKSESGGSEYGTGPGRKRRRKHREKKEKKTKRRKKGEGDGGQKQVEQKSSATLLLTWGLEDVEHVFSEEDYHTLTNYKAFSQFMRPLIAKKNPKIPMSKMMTILGAKWREFSANNPFKGSAAAVAAAAAAAAAAVAEQVSAAVSSATPIAPSGPPALPPPPAADIQPPPIRRAKTKEGKGPGHKRRSKSPRVPDGRKKLRGKKMAPLKIKLGLLGGKRKKGGSYVFQSDEGPEPEAEESDLDSGSVHSASGRPDGPVRTKKLKRGRPGRKKKKVLGCPAVAGEEEVDGYETDHQDYCEVCQQGGEIILCDTCPRAYHLVCLDPELDRAPEGKWSCPHCEKEGVQWEAKEEEEEYEEEGEEEGEKEEEDDHMEYCRVCKDGGELLCCDACISSYHIHCLNPPLPDIPNGEWLCPRCTCPVLKGRVQKILHWRWGEPPVAVPAPQQADGNPDVPPPRPLQGRSEREFFVKWVGLSYWHCSWAKELQLEIFHLVMYRNYQRKNDMDEPPPLDYGSGEDDGKSDKRKVKDPHYAEMEEKYYRFGIKPEWMTVHRIINHSVDKKGNYHYLVKWRDLPYDQSTWEEDEMNIPEYEEHKQSYWRHRELIMGEDPAQPRKYKKKKKELQGDGPPSSPTNDPTVKYETQPRFITATGGTLHMYQLEGLNWLRFSWAQGTDTILADEMGLGKTIQTIVFLYSLYKEGHTKGPFLVSAPLSTIINWEREFQMWAPKFYVVTYTGDKDSRAIIRENEFSFEDNAIKGGKKAFKMKREAQVKFHVLLTSYELITIDQAALGSIRWACLVVDEAHRLKNNQSKFFRVLNGYKIDHKLLLTGTPLQNNLEELFHLLNFLTPERFNNLEGFLEEFADISKEDQIKKLHDLLGPHMLRRLKADVFKNMPAKTELIVRVELSPMQKKYYKYILTRNFEALNSRGGGNQVSLLNIMMDLKKCCNHPYLFPVAAMESPKLPSGAYEGGALIKSSGKLMLLQKMLRKLKEQGHRVLIFSQMTKMLDLLEDFLDYEGYKYERIDGGITGALRQEAIDRFNAPGAQQFCFLLSTRAGGLGINLATADTVIIFDSDWNPHNDIQAFSRAHRIGQANKVMIYRFVTRASVEERITQVAKRKMMLTHLVVRPGLGSKAGSMSKQELDDILKFGTEELFKDENEGENKEEDSSVIHYDNEAIARLLDRNQDATEDTDVQNMNEYLSSFKVAQYVVREEDKIEEIEREIIKQEENVDPDYWEKLLRHHYEQQQEDLARNLGKGKRVRKQVNYNDAAQEDQDNQSEYSVGSEEEDEDFDERPEGRRQSKRQLRNEKDKPLPPLLARVGGNIEVLGFNTRQRKAFLNAVMRWGMPPQDAFTTQWLVRDLRGKTEKEFKAYVSLFMRHLCEPGADGSETFADGVPREGLSRQQVLTRIGVMSLVKKKVQEFEHINGRWSMPELMPDPSADSKRSSRASSPTKTSPTTPEASATNSPCTSKPATPAPSEKGEGIRTPLEKEEAENQEEKPEKNSRIGEKMETEADAPSPAPSLGERLEPRKIPLEDEVPGVPGEMEPEPGYRGDREKSEDVKGDRELRPGPRDEPRSNGRREEKTEKPRFMFNIADGGFTELHTLWQNEERAAISSGKLNEIWHRRHDYWLLAGIVLHGYARWQDIQNDAQFAIINEPFKTEANKGNFLEMKNKFLARRFKLLEQALVIEEQLRRAAYLNLSQEPAHPAMALHARFAEAECLAESHQHLSKESLAGNKPANAVLHKVLNQLEELLSDMKADVTRLPATLSRIPPIAARLQMSERSILSRLASKGTEPHPTPAYPPGPYATPPGYGAAFSAAPVGALAAAGANYSQMPAGSFIT

SEQ ID NO: 10971 - protein, 324 aa, Human
RNLGKSGLRVSCLGLGTWVTFGSQISDETAEDVLTVAYEHGVNLFDTAEVYAAGKAERTLGNILKSKGWRRSSYVITTKIFWGGQAETERGLSRKHIIEGLRGSLERLQLGYVDIVFANRSDPNCPMEEIVRAMTYVINQGLALYWGTSRWGAAEIMEAYSMARQFNLIPPVCEQAEHHLFQREKVEMQLPELYHKIGVGSVTWYPLACGLITSKYDGRVPDTCRASIKGYQWLKDKVQSEDGKKQQAKVMDLLPVAHQLGCTVAQLAIAWCLRSEGVSSVLLGVSSAEQLIEHLGALQVLSQLTPQTVMEIDGLLGNKPHSKK

SEQ ID NO: 10972 - protein, 513 aa, Human
QPFPAASARPGALGAVRAPLPRESLKREPASCLPGAMEAVELARKLQEEATCSICLDYFTDPVMTTCGHNFCRACIQLSWEKARGKKGRRKRKGSFPCPECREMSPQRNLLPNRLLTKVAEMAQQHPGLQKQDLCQEHHEPLKLFCQKDQSPICVVCRESREHRLHRVLPAEEAVQGYKLKLEEDMEYLREQITRTGNLQAREEQSLAEWQGKVKERRERIVLEFEKMNLYLVEEEQRLLQALETEEEETASRLRESVACLDRQGHSLELLLLQLEERSTQGPLQMLQDMKEPLSRKNNVSVQCPEVAPPTRPRTVCRVPGQIEVLRGFLEDVVPDATSAYPYLLLYESRQRRYLGSSPEGSGFCSKDRFVAYPCAVGQTAFSSGRHYWEVGMNITGDALWALGVCRDNVSRKDRVPKCPENGFWVVQLSKGTKYLSTFSALTPVMLMEPPSHMGIFLDFEAGEVSFYSVSDGSHLHTYSQATFPGPLQPFFCLGAPKSGQMVISTVTMWVKG

SEQ ID NO: 10973 - protein, 160 aa, Human
MSGPRPVVLSGPSGAGKSTLLKRLLQEHSGIFGFSVSHTTRNPRPGEENGKDYYFVTREVMQRDIAAGDFIEHAEFSGNLYGTSKVAVQAVQAMNRICVLDVDLQGVRNIKATDLRPIYISVQPPSLHVLEQRLRQRNTETEESLVKRLAAAQADMESSE

SEQ ID NO: 10974 - protein, 313 aa, Human
ARRGGATRRGWRRDQKPLPQAEPTSAGTRAQGRGGGGGDCSGWTMAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 10975 - protein, 464 aa, Human
KQASWVTALGKVREVPMAMSELGTRKPSDGTVSHLLNVVESELQAGREKGDPTEKQLQIILEDAPLWQRFKEVTNEMIVTKNGRRMFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLGGWIFSNPDGVCTAGNSNYQYAAPLPLPAPHTHHGCEHYSGLRGHRQAPYPSAYMHRNHSPSVNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 10976 - protein, 1341 aa, Human
MTEKFSSAMYMDRGAEQLVEILNYHISAIVEKVLIFGGDILKFAGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVIIAISLNKISFHQTFYTIQMFMANVLGLDTCKHYKERQTNLRNKVMTLLDEKFYCLLNDIFHVQIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGLFQYGPDSACQENAEEGTEAPQPNLSLQLNLLVSPYPCREKQTLSLCESAGPREPTSRIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKESWYSTSELKEDQWLQTILSLPSWEKIVAGRVNIQDLQKNKFLMRANTVDNHF

SEQ ID NO: 10977 - protein, 512 aa, Human
MTAPWVALALLWGSLCAGSGRGEAETRECIYYNANWELERTNQSGLERCEGEQDKRLHCYASWRNSSGTIELVKKGCWLDDFNCYDRQECVATEENPQVYFCCCEGNFCNERFTHLPEAGGPEVTYEPPPTAPTLLTVLAYSLLPIGGLSLIVLLAFWMYRHRKPPYGHVDIHEDPGPPPPSPLVGLKPLQLLEIKARGRFGCVWKAQLMNDFVAVKIFPLQDKQSWQSEREIFSTPGMKHENLLQFIAAEKRGSNLEVELWLITAFHDKGSLTDYLKGNIITWNELCHVAETMSRGLSYLHEDVPWCRGEGHKPSIAHRDFKSKNVLLKSDLTAVLADFGLAVRFEPGKPPGDTHGQVGTRRYMAPEVLEGAINFQRDAFLRIDMYAMGLVLWELVSRCKAADGPVDEYMLPFEEEIGQHPSLEELQEVVVHKKMRPTIKDHWLKHPGLAQLCVTIEECWDHDAEARLSAGCVEERVSLIRRSVNGTTSDCLVSLVTSVTNVDLPPKESSI

SEQ ID NO: 10978 - protein, 554 aa, Human
LAYMAQFVQVLAEIGDFGRFQIQLLILLCVLNFLSPFYFFAHVFMVLDEPHHCAVAWVKNHTFNLSAAEQLVLSVPLDTAGHPEPCLMFRPPPANASLQDILSHRFNETQPCDMGWEYPENRLPSLKNEFNLVCDRKHLKDTTQSVFMAGLLVGTLMFGPLCDRIGRKATILAQLLLFTLIGLATAFVPSFELYMALRFAVATAVAGLSFSNVTLLTEWVGPSWRTQAVVLAQCNFSLGQMVLAGLAYGFRNWRLLQITGTAPGLLLFFYFWALPESARWLLTRGRMDEAIQLIQKAASVNRRKLSPELMNQLVPEKTGPSGNALDLFRHPQLRKVTLIIFCVWFVDSLGYYGLSLQVGDFGLDVYLTQLIFGAVEVPARCSSIFMMQRFGRKWSQLGTLVLGGLMCIIIIFIPADLPVVVTMLAVVGKMATAAAFTISYVYSAELFPTILRQTGMGLVGIFSRIGGILTPLVILLGEYHAALPMLIYGSLPIVAGLLCTLLPETHGQGLKDTLQDLELGPHPRSPKSVPSEKETEAKGRTSSPGVAFVSSTYF

SEQ ID NO: 10979 - protein, 609 aa, Human
EVVSAETELHPFFGQMAGEENFKEELRSQDASRNLNQHEVAGHPHSWSLEMLLRRLRAVHTKQDDKFANLLDAVGEFGTFQQRLVALTFIPSIMSAFFMFADHFVFTAQKPYCNTSWILAVGPHLSKAEQLNLTIPQAPNGSFLTCFMYLPVPWNLDSIIQFGLNDTDTCQDGWIYPDAKKRSLINEFDLVCGMETKKDTAQIMFMAGLPIGSLIFRLITDKMGRYPAILLSLLGLIIFGFGTAFMNSFHLYLFFRFGISQSVVGYAISSISLATEWLVGEHRAHAIILGHCFFAVGAMLLTGIAYGLPHWQLLFLVGGILVIPFISYIWILPESPRWLMMKGKVKEAKQVLCYAASVNKKTIPSNLLDELQLPRKKVTRASVLDFCKNRQLCKVTLVMSCVWFTVSYTYFTLSLRMRELGVSVHFRHVVPSIMEVPARLCCIFLLQQIGRKWSLAVTLLQAIIWCLLLLFLPEGEDGLRLKWPRCPATELKSMTILVLMLREFSLAATVTVFFLYTAELLPTVLRATGLGLVSLASVAGAILSLTIISQTPSLLPIFLCCVLAIVAFSLSSLLPETRDQPLSESLNHSSQIRNKVKDMKTKETSSDDV

SEQ ID NO: 10980 - protein, 478 aa, Human
CACGGVHVHKDGLTVTSPVLMWVQALDIILEKMKASGFEFSQVLALSGAGQQHGSIYWKAGAQQALTSLSPDLRLHQQLQDCFSISDCPVWMDSSTTAQCRQLEAAVGGAQALSCLTGSRAYERFTGNQIAKIYQQNPEAYSHTERISLVSSFAASLFLGSYSPIDYSDGSGMNLLQIQDKVWSQACLGACAPHLEEKLSPPVPSCSVVGAISSYYVQRYGFPPGCKVVAFTGDNPASLAGMRLEEGDIAVSLGTSDTLFLWLQEPMPALEGHIFCNPVDSQHYMALLCFKNGSLMREKIRNESVSRSWSDFSKALQSTEMGNGGNLGFYFDVMEITPEIIGRHRFNTENHKVAAFPGDVEVRALIEGQFMAKRIHAEGLGYRVMSKTKILATGGASHNREILQVLADVFDAPVYVIDTANSACVGSAYRAFHGLAGGTDVPFSEVVKLAPNPRLAATPSPGASQVRDHQNLFVAFAL

SEQ ID NO: 10981 - protein, 522 aa, Human
RSCSTSSGRRAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 10982 - protein, 588 aa, Human
APAALPRGDPAPRRRPTRGCSETIGGGAAAAAAAVGGGETRGEETSEVSEFEGGPRAAAAVMSEDSSALPWSINRDDYELQEVIGSGATAVVQAAYCAPKKEKVAIKRINLEKCQTSMDELLKEIQAMSQCHHPNIVSYYTSFVVKDELWLVMKLLSGGSVLDIIKHIVAKGEHKSGVLDESTIATILREVLEGLEYLHKNGQIHRDVKAGNILLGEDGSVQIADFGVSAFLATGGDITRNKVRKTFVGTPCWMAPEVMEQVRGYDFKADIWSFGITAIELATGAAPYHKYPPMKVLMLTLQNDPPSLETGVQDKEMLKKYGKSFRKMISLCLQKDPEKRPTAAELLRHKFFQKAKNKEFLQEKTLQRAPTISERAKKVRRVPGSSGRLHKTEDGGWEWSDDEFDEESEEGKAAISQLRSPRVKESISNSELFPTTDPVGTLLQVPEQISAHLPQPAGQIATQPTQVSLPPTAEPAKTAQALSSGSGSQETKIPISLVLRLRNSKKELNDIRFEFTPGRDTAEGVSQELISAGLVDGRDLVIVAANLQKIVEEPQSNRSVTFKLASGVEGSDIPDDGKLIGFAQLSIS

SEQ ID NO: 10983 - protein, 941 aa, Human
EELLLSEMVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 10984 - protein, 941 aa, Human; identical to SEQ ID NO: 10983

SEQ ID NO: 10985 - protein, 941 aa, Human; identical to SEQ ID NO: 10983

SEQ ID NO: 10986 - protein, 518 aa, Human
NVVDIAEARGLKLLGMVQTTSPVNGNITDLVVQLGCSLQRCACVTRAELKEPGKHWAVIAYVEGIKTLGEALHIGGADSLQEVNVVLGVEAAHVMLGGLVWLEDDHLLIETVMQDQAMGQCQAMGLHRVSSSCAPPPGPGPATGEGIWEARAAAEAISLTQGRSCPEPATALSQPASFSVLPSPRLPRRGYPQPQPGAGEAAKGEGRNQGMSAGRASGALSRTRTPLEPEPQQKPEPEPNHRYRVGQVVRGLMSEPQPDLEPPQHGLYMLFLLVLVFFLMGLVGFMICHVLKKKGYRCRTSRGSEPDDAQLQPPEDDDMNEDTVERIVRCIIQNEANAEALKEMLGDSEGEGTVQLSSVDATSSLQDGAPSHHHTVHLGSAAPCLHCSRSKRPPLVRQGRSKEGKSRPRTGETTVFSVGRFRVTHIEKRYGLHEHRDGSPTDRSWGSGVSTTGSREYVSPADKTGLVGITPLHTISSKARALTGLSRGAIMSRNPGKSRALSGNKNHKSVFRLCFVQC

SEQ ID NO: 10987 - protein, 898 aa, Human
GLRVRAEVGQAGGSEASSLYIHEARAARHANEAGRGGWLKSDWAAAGAELPGGSGVGAGSPASVNRDMEPPGGSLGPGRGTRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKVGCLQLINALITPAEELDFRVHIRSELMRLGLHQVLQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGELVAEDLSQDCFWTKVKEDRFENNELFAKLTLTFSAQTKTIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDNFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 10988 - protein, 1525 aa, Human
LKEQDEKMAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKIIWRSRHFYDRRTEEILQCNEKTGFKETTKTHTSTC

SEQ ID NO: 10989 - protein, 164 aa, Human
AASMDDIYKAAVEQLTEEQKNEFKAAFDIFVLGAEDGCISTKELGKVMRMLGQNPTPEELQEMIDEVDEDGSGTVDFDEFLVMMVRCMKDDSKGKSEEELSDLFRMFDKNADGYIDLDELKIMLQATGETITEDDIEELMKDGDKNNDGRIDYDEFLEFMKGVE

SEQ ID NO: 10990 - protein, 665 aa, Human
VPASFAAASAVLSAVFPQEPAYFLNMESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 10991 - protein, 421 aa, Human
AQRQESELTTRSAMTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 10992 - protein, 795 aa, Human
LFGLLGILIALLDGSYCMMPSNIRQKSSNNVRISMINNPAKEISYENTQISRAIWAALQTQTSNAAKNFITKMAKEGAAEALAAGADIAEFSVGGMDFSLFKEVFESSKMDFILSHAVYCRDVLKLKKGQRAVISNGRIIGPLEDSELFNQDDFHLLENIILKTSGQKIKSHIQQLRVEEDVASDLVMKVDALLSAQPKGDPRIEYQFFEDRHSAIKLRPKEGETYFDVVAVVDPVTREAQRLAPLLLVLAQLINMNLRVFMNCQSKLSDMPLKSFYRYVLEPEISFTSDNSFAKGPIAKFLDMPQSPLFTLNLNTPESWMVESVRTPYDLDNIYLEEVDSVVAAEYELEYLLLEGHCYDITTGQPPRGLQFTLGTSANPVIVDTIVMANLGYFQLKANPGAWILRLRKGRSEDIYRIYSHDGTDSPPDADEVVIVLNNFKSKIIKVKVQKKADMVNEDLLSDGTSENESGFWDSFKWGFTGQKTEEVKQDKDDIINIFSVASGHLYERFLRIMMLSVLKNTKTPVKFWFLKNYLSPTFKEFIPYMANEYNFQYELVQYKWPRWLHQQTEKQRIIWGYKILFLDVLFPLVVDKFLFVDADQIVRTDLKELRDFNLDGAPYGYTPFCDSRREMDGYRFWKSGYWASHLAGRKYHISALYVVDLKKFRKIAAGDRLRGQYQGLSQDPNSLSNLDQDLPNNMIHQVPIKSLPQEWLWCETWCDDASKKRAKTIDLCNNPMTKEPKLEAAVRIVPEWQDYDQEIKQLQIRFQKEKETGALYKEKTKEPSREGPQKREEL

SEQ ID NO: 10993 - protein, 665 aa, Human
LPTPCMQLSALGCKPVTSPSTSGSSARLESLMELCSLLRQLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 10994 - protein, 170 aa, Human
PGPFLRLRGTLNMSGIALSRLAQERKAWRKDHPFGFVAVPTKNPDGTMNLMNWECAIPGKKGTPWEGGLFKLRMLFKDDYPSSPPKCKFEPPLFHPNVYPSGTVCLSILEEDKDWRPAITIKQILLGIQELLNEPNIQDPAQAEAYTIYCQNRVEYEKRVRAQAKKFAPS

SEQ ID NO: 10995 - protein, 623 aa, Human
HSRRTLPRCLPAACPACRMALRKGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 10996 - protein, 272 aa, Human
DLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTGDTLFVAGCGKFYEGTADEMCKALLEVLGRLPPDTRVYCGHEYTINNLKFARHVEPGNAAIREKLAWAKEKYSIGEPTVPSTLAEEFTYNPFMRVREKTVQQHAGETDPVTTMRAVRREKDQFKMPRD

SEQ ID NO: 10997 - protein, 307 aa, Human
GHGGRLLRRGPRRGRPGPRELCAAAPDPAPGRVLGVLHRRLRAHRQRGLREHRQRPRAALRVQRERGRLPLRRRAGPRSLPRLRRLPAARCALPANQQRPRPPARGVAGPGLLRTLVLPVVRGLLLPHQSVAAHGARAGHDAGGGRGAGRHRLQLLLHPQLGGAHREGPAAVPPGHRHVTLRHRTAEHRGEPGLPRLSGGQRRGGHRDLPEPALHRDPGHQPQRVPGARLLAAGRHRPGLQGHPTNAGPRVSGTSLGSFQLSAADRVGGRFAPSGAKRGWTRVSGLPLPSSPSPSAPGPRTEVLRRG

SEQ ID NO: 10998 - protein, 140 aa, Human
RKPGFALRGAIGPREGRGGGRGYRRSSGRQPLVSWQRQARCGSGGAMSFCSFFGGEVFQNHFEPGVYVCAKCGYELFSSRSKYAHSSPWPAFTETIHADSVAKRPEHNRSEALKVSCGKCGNGLGHEFLNDGPKPGQSRF

SEQ ID NO: 10999 - protein, 312 aa, Human
MCSPQESGMTALSARMLTRSRSLGPGAGPRGCREEPGPLRRREAAAEARKSHSPVKRPRKAQRLRVAYEGSDSEKGEGAEPLKVPVWEPQDWQQQLVNIRAMRNKKDAPVDHLGTEHCYDSSAPPKVRRYQVLLSLMLSSQTKDQVTAGAMQRLRARGLTVDSILQTDDATLGKLIYPVGFWRSKVKYIKQTSAILQQHYGGDIPASVAELVALPGVGPKMAHLAMAVAWGTVSGIAVDTHVHRIANRLRWTKKATKSPEETRAALEEWLPRELWHEINGLLVGFGQQTCLPVHPRCHACLNQALCPAAQGL

SEQ ID NO: 11000 - protein, 300 aa, Human
SFPTKHQMADDAGAAGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 11001 - protein, 861 aa, Human
SHGRRRSSRGPVARHVAAGAGHENKHGGSRRFPAGVAPRRAMANVSKKVSWSGRDRDDEEAAPLLRRTARPGGGTPLLNGAGPGAARQSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGSILPNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGEEGRTGSNALPSPCGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTEASLPRVFKLFRALGLRHLVVVDNRNQVVGLVTRKDLARYRLGKRGLEELSLAQT

SEQ ID NO: 11002 - protein, 847 aa, Human
PAGPWAQAQLRPPGMDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRLECSGTISPHCNLLLPGSSNSPASASRVAGITGL

SEQ ID NO: 11003 - protein, 270 aa, Human
SRDPNGWWRRLRVSAELAMAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 11004 - protein, 422 aa, Human
GLVTMEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 11005 - protein, 153 aa, Human
QFRRATQKETTMSLLPVPYTEAASLSTGSTVTIKGRPLACFLNEPYLQVDFHTEMKEESDIVFHFQVCFGRRVVMNSREYGAWKQQVESKNMPFQDGQEFELSISVLPDKYQVMVNGQSSYTFDHRIKPEAVKMVQVWRDISLTKFNVSYLKR

SEQ ID NO: 11006 - protein, 334 aa, Human
TPRTPEPHKPGLAMKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDQTRIVALNAHTFLRNGGHFVISIKANCIDSTASAEAVFASEVKKMQQENMKPQEQLTLEPYERDHAVVVGVYRPPPKVKN

SEQ ID NO: 11007 - protein, 343 aa, Human
LQRSHSRPTPLMANRYTMDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPPPPGDLPLSPSAFSAAPGTPLARRDPTPVCCPSCRRATPISVWGPLGGLVRTPSVQSLGSDPDEYASSGSSLGGSDSPVFEAGVFAPPQPVAAPRRLPIFNRISVSE

SEQ ID NO: 11008 - protein, 151 aa, Human; identical to SEQ ID NO: 8905

SEQ ID NO: 11009 - protein, 143 aa, Human
RQSDSLVVCEVDPELTEKLRKFRFRKETDNAAIIMKVDKDRQMVVLEEEFQNISPEELKMELPERQPRFVVYSYKYVHDDGRVSYPLCFIFSSPVGCKPEQQMMYAGSKNRLVQTAELTKVFEIRTTDDLTEAWLQEKLSFFR

SEQ ID NO: 11010 - protein, 146 aa, Human
QLVGNPFLSPPEKYMEFDLNGNGDIGEKRVICGGRVVCRPKKTEVSPTCSIPHDLGGGPPTTVGGRRMGMRKWERRERVSPPSPHPHPLPPDIMSLKRMLEKLGVPKTHLELKKLIGEVSSGSGETFSYPDFLRMMLGKRSAILKM

SEQ ID NO: 11011 - protein, 146 aa, Human; identical to SEQ ID NO: 11010

SEQ ID NO: 11012 - protein, 404 aa, Human
PSFLNTGLGPTALGVLGGAGAGLMSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSCRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 11013 - protein, 233 aa, Human
CPRIREDWVSEAARGGARNRSQPRAPSCPPHRRSAEGAGARLGDDEGTGVSDERDAVLGRRGAGAPAGRPLLPLLSRRLPGPGAPWRRGPPGPLGHAAQLSVPGGGRLRAGHSRAAARGRRDGDSSAGPGQETRVRASLVHERGVRRPGAAPEGREGVRQHQSPRYGGLREREDLLWGRDGGVREYECVVRVREYWGPGRPGPHGSGKNVGDCLEIDFEPDENKEWKASVLPI

SEQ ID NO: 11014 - protein, 265 aa, Human
DPPSPVPAPPSSPRDGHFLVPDATMAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCNLLPKLHIVQVVCKKYRGFTIPEAFRGVHRYLSNAYAREEFASTCPDDEEIELAYEQVAKALK

SEQ ID NO: 11015 - protein, 298 aa, Human
EIRAVGGGVCVDGMGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLHRGGGDLPNSQEALQKLSDVTLVPVSCSELEKAGAGLSSLCLVLSTRPHS

SEQ ID NO: 11016 - protein, 855 aa, Human
DVHDSPHRALRPLPSKGASKLMASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGRCAPSCTLAWATEQELWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 11017 - protein, 425 aa, Human
LPGSRQLRGEMTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPKQENDFNPDECQPYELPDGSVVINARNQNNYHCHCRIVLRSYDACDTLRPRDVTFDPELVDPVVAAGAVVTSSGIVFFSNPAHPEFRVNLTLRWSFSNGTSWRKETVQLWPGPSGYSSLATLEGSMDGEEQAPQLYVLYEKGRNHYTESISVAKISVYGTL

SEQ ID NO: 11018 - protein, 1016 aa, Human
PPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 11019 - protein, 769 aa, Human
PFPSRGSLPLAAPREDTMGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 11020 - protein, 405 aa, Human
ARYQRPARARPETVGPPVAAPSGATMLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 11021 - protein, 798 aa, Human
VWSFSLDTEPSRQAKQARTHHPAPGPASLLPSNAMGSNLSPQLCLMPFILGLLSGGVTTTPWSLAWPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 11022 - protein, 645 aa, Human
AGLGNRLLVGGWGGKMAELMLLSEIADPTRFFTDNLLSPEDWDSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLRPCQAVGPRGTMRR

SEQ ID NO: 11023 - protein, 308 aa, Human
RVVSGSMLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 11024 - protein, 263 aa, Human
TPNRAPKKKMAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGVRKSNAAERRGPL

SEQ ID NO: 11025 - protein, 404 aa, Human
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 11026 - protein, 455 aa, Human [sequence omitted]

SEQ ID NO: 11027 - protein, 258 aa, Human
QAARQVLFLSHTDPRLHPLSPGKDTMSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 11028 - protein, 261 aa, Human
FPLPPPHFACRGRVRGLRCSGRRRSLEVATSLPHPSPGPRPAADVKMSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 11029 - protein, 180 aa, Human
MAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGVDLGQGHPASSWQDSLFLFLAIFFFFWLLSI

SEQ ID NO: 11030 - protein, 522 aa, Human
MEPGGARLRLQRTEGLGGERERQPCGDGNTETHRAPDLVQWTRHMEAVKAQLLEQAQGQLRELLDRAMREAIQSYPSQDKPLPPPPPGSLSRTQEPSLGKQKVFIIRKSLLDELMEVQHFRTIYHMFIAGLCVFIISTLAIDFIDEGRLLLEFDLLIFSFGQLPLALVTWVPMFLSTLLAPYQALRLWARGTWTQATGLGCALLAAHAVVLCALPVHVAVEHQLPPASRCVLVFEQVRFLMKSYSFLREAVPGTLRARRGEGIQAPSFSSYLYFLFCPTLIYRETYPRTPYVRWNYVAKNFAQALGCVLYACFILGRLCVPVFANMSREPFSTRALVLSILHATLPGIFMLLLIFFAFLHCWLNAFAEMLRFGDRMFYRDWWNSTSFSNYYRTWNVVVHDWLYSYVYQDGLRLLGARARGVAMLGVFLVSAVAHEYIFCFVLGFFYPVMLILFLVIGGMLNFMMHDQRTGPAWNVLMWTMLFLGQGIQVSLYCQEWYARRHCPLPQATFWGLVTPRSWSCHT

SEQ ID NO: 11031 - protein, 721 aa, Human
GMVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQESK

SEQ ID NO: 11032 - protein, 447 aa, Human
HRRPQSLSPVLSLSPDSMSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 11033 - protein, 502 aa, Human
APSRISAWFGPPASTPASTMSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 11034 - protein, 384 aa, Human
LSSLDKGIMSCQISCKSRGRGGGGGGFRGFSSGSAVVSGGSRRSTSSFSCLSRHGGGGGGFGGGGFGSRSLVGLGGTKSISISVAGGGGGFGAAGGFGGRGGGFGGGSSFGGGSGFSGGGFGGGGFGGGRFGGFGGPGGVGGLGGPGGFGPGGYPGGIHEVSVNQSLLQPLNVKVDPEIQNVKAQEREQIKTLNNKFASFIDKVRFLEQQNQVLQTKWELLQQMNVGTRPINLEPIFQGYIDSLKRYLDGLTAERTSQNSELNNMQDLVEDYKKKYEDEINKRTAAENDFVTLKKDVDNAYMIKVELQSKVDLLNQEIEFLKVLYDAEISQIHQSVTDTNVILSMDNSRNLDLDSIIAEVKAQYEEIAQRSKEEAEALYHSKAI

SEQ ID NO: 11035 - protein, 569 aa, Human
LSSPGTMASTSTTIRSHSSSRRGFSANSARLPGVSRSGFSSVSVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPTIQRVRAEEREQIKTLNNKFASFIDKVRFLEQQNKVLETKWTLLQEQGTKTVRQNLEPLFEQYINNLRRQLDSIVGERGRLDSELRGMQDLVEDFKNKYEDEINKRTAAENEFVTLKKDVDAAYMNKVELQAKADTLTDEINFLRALYDALSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCANLQAAIADAEQRGEMALKDAKNKLEGLEDALQKAKQDLARLLKEYQELMNVKLALDVEIATYRKLLEGEECRLNGEGVGQVNISVVQSTVSSGYGGASGVGSGLGLGGGSSYSYGSGLGVGGGFSSSSGRAIGGGLSSVGGGSSTIKYTTTSSSSRKSYKH

SEQ ID NO: 11036 - protein, 569 aa, Human
LSSPGTMASTSTTIRSHSSSRRGFSASSARLPGVSRSGFSSISVSRSRGSGGLGGACGGAGFGSRSLYGLGGSKRISIGGGSCAISGGYGSRAGGSYGFGGAGSGFGFGGGAGIGFGLGGGAGLAGGFGGPGFPVCPPGGIQEVTVNQSLLTPLNLQIDPAIQRVRAEEREQIKTLNNKFASFIDKVRFLEQQNKVLDTKWTLLQEQGTKTVRQNLEPLFEQYINNLRRQLDSIVGERGRLDSELRNMQDLVEDLKNKYEDEINKRTAAENEFVTLKKDVDAAYMNKVELQAKADTLTDEINFLRALYDALSQMQTHISDTSVVLSMDNNRNLDLDSIIAEVKAQYEEIAQRSRAEAESWYQTKYEELQVTAGRHGDDLRNTKQEIAEINRMIQRLRSEIDHVKKQCANLQAAIADAEQRGEMALKDAKNKLEGLEDALQKAKQDLARLLKEYQELMNVKLALDVEIATYRKLLEGEECRLNGEGVGQVNISVVQSTVSSGYGGASGVGSGLGLGGGSSYSYGSGLGVGGGFSSSSGRATGGGLSSVGGGSSTIKYTTTSSSSRKSYKH

SEQ ID NO: 11037 - protein, 257 aa, Human
SCAATALEGEDGAQTLTMTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 11038 - protein, 270 aa, Human
ARQDTQEERAAPGSRPGLHAEAGGRRCPAESPELRRPALVPAPSGRRFESDWCLAASSRCGTMKLLPSVVLKLFLAAVLSALVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLPVENRLYTYDHTTILAVVAVVLSSVCLLVIVGLLMFRYHRRGGYDVENEEKVKLGMTNSH

SEQ ID NO: 11039 - protein, 220 aa, Human
GASLGSSSSCPSHSWWGQRSVCRETASPLPRWMLYLDGLATSHFLHHPEPHLLPSPGVFTRLCLPPLPRTLFPLGMCDELPGEGRWEPGQDRKLCLSFPLGTPSQTNKKRLSHSAKPGFLEQRDGTEGERGSGRLHLSSCSLCIRALPFLGDGPCPLLFSLPVPLTNAQLPGLHAVDRRGRKNRCSQLNLSEQNSSPWMAVCLKIPFPAFSHTFQKEVQQ

SEQ ID NO: 11040 - protein, 363 aa, Human
TATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSESTCWT

SEQ ID NO: 11041 - protein, 285 aa, Human
VPRAPRSAMSSCSRVALVTGANRGIGLAIARELCRQFSGDVVLTARDVARGQAAVQQLQAEGLSPRFHQLDIDDLQSIRALRDFLRKEYGGLNVLVNNAAVAFKSDDPMPFDIKAEMTLKTNFFATRNMCNELLPIMKPHGRVVNISSLQCLRAFENCSEDLQERFHSETLTEGDLVDLMKKFVEDTKNEVHEREGWPNSPYGVSKLGVTVLSRILARRLDEKRKADRILVNACCPGPVKTDMDGKDSIRTVEEGAETPVYLALLPPDATEPQGQLVHDKVVQNW

SEQ ID NO: 11042 - protein, 308 aa, Human
QTRAVSGTRCGAPGPEPGLFSTQVFRAPRSAMSSGIHVALVTGGNKGIGLAIVRDLCRLFSGDVVLTARDVTRGQAAVQQLQAEGLSPRFHQLDIDDLQSIRALRDFLRKEYGGLDVLVNNAGIAFKVADPTPFHIQAEVTMKTNFFGTRDVCTELLPLIKPQGRVVNVSSIMSVRALKSCSPELQQKFRSETITEEELVGLMNKFVEDTKKGVHQKEGWPSSAYGVTKIGVTVLSRIHARKLSEQRKGDKILLNACCPGWVRTDMAGPKATKSPEEGAETPVYLALLPPDAEGPHGQFVSEKRVEQW

SEQ ID NO: 11043 - protein, 395 aa, Human
DPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNKEQLVKTRKGGIQTQLPFQRRRPTRPLEVGAPFYQDGQLQVKVYWKKTEDPTVNRYHVRWFPEACAHNRTTGSEASSGMTHENYIILQDLSFSCKYKVTVQPIRPKSHSKAEAVFFTTPPCSALKGKSHKPVGCLGEAGHVLSKVLAKPENLSASFIVQDVNITGHFSWKMAKANLYQPMTGFQVTWAEVTTESRQNSLPNSIISQSQILPSDHYVLTVPNLRPSTLYRLEVQVLTPGGEGPATIKTFRTPELPPSSAHRSHLKHRHPHHYKPSPERY

SEQ ID NO: 11044 - protein, 819 aa, Human
ALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 11045 - protein, 549 aa, Human
RGLPDRDMDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 11046 - protein, 483 aa, Human
GTVITSLFGGTVMAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 11047 - protein, 1163 aa, Human
TLLLNMTHGEELGSDVHQDSIVLTYLEGLLMHQAAGGSGTAVDKKSAGHNEEDQNFNISGSAFPTCQSNGPVLNTHTYQGSGMLHLKKARLLQSSEDWNAAKRKRLSDSIMNLNVKKEALLAGMVDSVPKGKQDSTLLASLLQSFSSRLQTVALSQQIRQSLKEQGYALSHDSLKVEKDLRCYGVASSHLKTLLKKSKVKDQKPDTNLPDVTKNLIRDRFAESPHHVGQSGTKVMSEPLSCAARLQAVASMVEKRASPATSPKPSVACSQLALLLSSEAHLQQYSREHALKTQNANQAASERLAAMARLQENGQKDVGSYQLPKGMSSHLNGQARTSSSKLMASKSSATVFQNPMGIIPSSPKNAGYKNSLERNNIKQAANNSLLLHLLKSQTIPKPMNGHSHSERGSIFEESSTPTTIDEYSDNNPSFTDDSSGDESSYSNCVPIDLSCKHRTEKSESDQPVSLDNFTQSLLNTWDPKVPDVDIKEDQDTSKNSKLNSHQKVTLLQLLLGHKNEENVEKNTSPQGVHNDVSKFNTQNYARTSVIESPSTNRTTPVSTPPLLTSSKAGSPINLSQHSLVIKWNSPPYVCSTQSEKLTNTASNHSMDLTKSKDPPGEKPAQNEGAQNSATFSASKLLQNLAQCGMQSSMSVEEQRPSKQLLTGNTDKPIGMIDRLNSPLLSNKTNAVEENKAFSSQPTGPEPGLSGSEIENLLERRTVLQLLLGNPNKGKSEKKEKTPLRDESTQEHSERALSEQILMVKIKSEPCDDLQIPNTNVHLSHDAKSAPFLGMAPAVQRSAPALPVSEDFKSEPVSPQDFSFSKNGLLSRLLRQNQDSYLADDSDRSHRNNEMALLESKNLCMVPKKRKLYTEPLENPFKKMKNNIVDAANNHSAPEVLYGSLLNQEELKFSRNDLEFKYPAGHGSASESEHRSWARESKSFNVLKQLLLSENCVRDLSPHRSNSVADSKKKGHKNNVTNSKPEFSISSLNGLMYSSTQPSSCMDNRTFSYPGVVKTPVSPTFPEHLGCAGSRPESGLLNGCSMPSEKGPIKWVITDAEKNEYEKDSPRLTKTNPILYYMLQKGGNSVTSRETQDKDIWREASSAESVSQVTAKEELLPTAETKASFFNLRSPYNSHMGNNASRPHSANGEVYGLLGSVLTIKKESE

SEQ ID NO: 11048 - protein, 1121 aa, Human
QSAFRRLPAVPAHAGRHRLRAWLAGALSSQAVRAAPWSSAERGSQGRRRREEPGATAAAAAAAAGAMTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 11049 - protein, 108 aa, Human
MILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 11050 - protein, 383 aa, Human
TRSESRLPAAAAHGTAATMALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 11051 - protein, 284 aa, Human
GPLRRSPQFPARTRSGPPNLRPKSGGGSGGKKMKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCCRYGEKNNAFIVASFENKDENKDEISRKVTRALDKVTSDYHSGSSSSDEETSKEMEVKPSSVTAAASPVYQISELIFPPLPMWHPLPRKKPGMYRGNGHQNHYPPPVPFGYPNQGRKNKPYRPIPVTWVPPPGMHCDRNHWINPHMLAPH

SEQ ID NO: 11052 - protein, 556 aa, Human
SKRQARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 11053 - protein, 173 aa, Human
NRMVYAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 11054 - protein, 138 aa, Human
PCSPILLFKLQQEGSMSTLSNFTQTLEDVFRRIFITYMDNWRQNTTAEQEALQAKVDAENFYYVILYLMVMIGMFSFIIVAILVSTVKSKRREHSNDPYHQYIVEDWQEKYKSQILNLEESKATIHENIGAAGFKMSP

SEQ ID NO: 11055 - protein, 539 aa, Human
LNRLVVMRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMARGPPVRDKPAGIPGPGPGHRPGAEGARRPGSRCRSGPRSLLRPEAHAAAVCWRPGPRGGVRGDAPRGCPPAPAPRGRAGKQTGRFPEGNCECF

SEQ ID NO: 11056 - protein, 273 aa, Human
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEVGRME

SEQ ID NO: 11057 - protein, 836 aa, Human
KAGDGSAAPAAAGALGAHRRRVSWALLSTALGKPRASPAWHLCLSPFRFPTQSHQRPGREEEVVLRCSPAEMSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKGNWSLASRRWPKQATLLLLHVAWCGALRTFSSSLPYLMFL

SEQ ID NO: 11058 - protein, 836 aa, Human; identical to SEQ ID NO: 11057

SEQ ID NO: 11059 - protein, 836 aa, Human; identical to SEQ ID NO: 11057

SEQ ID NO: 11060 - protein, 836 aa, Human; identical to SEQ ID NO: 11057

SEQ ID NO: 11061 - protein, 199 aa, Human
IHSKNHQEMGTWILFACLLGAAFAMPLPPHPGHPGYINFSYEVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 11062 - protein, 1587 aa, Human
RRSRRKRAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRFNVRGTNDDGHVANFVETEQVVYLDDSVSSFIQIRGSVPLFWEQPGLQVGSHRVRMSRGFEANAPAFDRHFRTLKNLYGKQIIVNLLGSKEGEHMLSKAFQSHLKASEHAADIQMVNFDYHQMVKGGKAEKLHSVLKPQVQKFLDYGFFYFNGSEVQRCQSGTVRTNCLDCLDRTNSVQAFLGLEMLAKQLEALGLAEKPQLVTRFQEVFRSMWSVNGDSISKIYAGTGALEGKAKLKDGARSVTRTIQNNFFDSSKQEAIDVLLLGNTLNSDLADKARALLTTGSLRVSEQTLQSASSKVLKSMCENFYKYSKPKKIRVCVGTWNVNGGKQFRSIAFKNQTLTDWLLDAPKLAGIQEFQDKRSKPTDIFAIGFEEMVELNAGNIVSASTTNQKLWAVELQKTISRDNKYVLLASEQLVGVCLFVFIRPQHAPFIRDVAVDTVKTGMGGATGNKGAVAIRMLFHTTSLCFVCSHFAAGQSQVKERNEDFIEIARKLSFPMGRMLFSHDYVFWCGDFNYRIDLPNEEVKELIRQQNWDSLIAGDQLINQKNAGQVFRGFLEGKVTFAPTYKYDLFSDDYDTSEKCRTPAWTDRVLWRRRKWPFDRSAEDLDLLNASFQDESKILYTWTPGTLLHYGRAELKTSDHRPVVALIDIDIFEVEAEERQNIYKEVIAVQGPPDGTVLVSIKSSLPENNFFDDALIDELLQQFASFGEVILIRFVEDKMWVTFLEGSSALNVLSLNGKELLNRTITIALKSPDWIKNLEEEMSLEKISIALPSSTSSTLLGEDAEVAADFDMEGDVDDYSAEVEELLPQHLQPSSSSGLGTSPSSSPRTSPCQSPTISEGPVPSLPIRPSRAPSRTPGPPSAQSSPIDAQPATPLPQKDPAQPLEPKRPPPPRPVAPPTRPAPPQRPPPPSGARSPAPTRKEFGGIGAPPSPGVARREMEAPKSPGTTRKDNIGRSQPSPQAGLAGPGPAGYSTARPTIPPRAGVISAPQSHARASAGRLTPESQSKTSETSKGSTFLPEPLKPQAAFPPQSSLPPPAQRLQEPLVPVAAPMPQSGPQPNLETPPQPPPRSRSSHSLPSEASSQPQVKTNGISDGKRESPLKIDPFEDLSFNLLAVSKAQLSVQTSPVPTPDPKRLIQLPSATQSNVLSSVSCMPTMPPIPARSQSQENMRSSPNPFITGLTRTNPFSDRTAAPGNPFRAKSEESEATSWFSKEEPVTISPFPSLQPLGHNKSRASSSLDGFKDSFDLQGQSTLKISNPKGWVTFEEEEDFGVKGKSKSACSDLLGNQPSSFSGSNLTLNDDWNKGTNVSFCVLPSRRPPPPPVPLLPPGTSPPVDPFTTLASKASPTLDFTER

SEQ ID NO: 11063 - protein, 319 aa, Human
AGMAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICK

SEQ ID NO: 11064 - protein, 362 aa, Human
GAGEDAAGPPPLEGFPAAARPVGRHRLRGQPSLWVSAFSCRQRPLIAAMGLLDSEPGSVLNVVSTALNDTVEFYRWTWSIADKRVENWPLMQSPWPTLSISTLYLLFVWLGPKWMKDREPFQMRLVLIIYNFGMVLLNLFIFRELFMGSYNAGYSYICQSVDYSNNVHEVRIAAALWWYFVSKGVEYLDTVFFILRKKNNQVSFLHVYHHCTMFTLWWIGIKWVAGGQAFFGAQLNSFIHVIMYSYYGLTAFGPWIQKYLWWKRYLTMLQLIQFHVTIGHTALSLYTDCPFPKWMHWALIAYAISFIFLFLNFYIRTYKEPKKPKAGKTAMNGISANGVSKSEKQLMIENGKKQKNGKAKGD

SEQ ID NO: 11065 - protein, 415 aa, Human
VNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 11066 - protein, 784 aa, Human
RKDARGCCPGGRPRARCGTAGVISMVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 11067 - protein, 129 aa, Human
TFRFLTHPCVSMSLIILTRDDEPRIFTPDSDAASPALHSTSPLPDPASASPLHREEKILPKVCNIVSCLSFSLPASPTDSGLASPTIITREGQQFWAKCLIWKYQLYLHGLHKKSDGRRDKQISASPST

SEQ ID NO: 11068 - protein, 245 aa, Human
WREEPKMPLLLLGETEPLKLERDCRSPVDPWAAASPDLALACLCHCQDLSSGAFPNRGVLGGVLFPTVEMVIKVFVATSSGSIAIRKKQQEVVGFLEANKIDFKELDIAGDEDNRRWMRENVPGEKKPQNGIPLPPQIFNEEQYCGDFDSFFSAKEENIIYSFLGLAPPPDSKGSEKAEEGGETEAQKEGSEDVGNLPEAQEKNEEEGETATEETEEIAMEGAEGEAEEEEETAEGEEPGEDEDS

SEQ ID NO: 11069 - protein, 240 aa, Human
LSSSGGGRSGSGKAAQFREGCRRAAARRHPARAFPAGTRHASAPPKAPPRKSPRGDRRGCQLNLLQKWKRSRKRQQRRINLQTKKCKQKGKGEQRENRPKWLTKKLKKTYLRKTGKRRLRRVQPLMKQERKKPSLINNHIPCLISGPCLPSCTIQRNIFINYFVNASFLVALETFLRRRESHLIPFFKCKCFFLRGEIICWLFIFWYNQKIVWDIELWEALTVSGVSLTFHRWGVSFYIL

SEQ ID NO: 11070 - protein, 188 aa, Human
GAAVADPAQPGASGMSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 11071 - protein, 335 aa, Human
ATAGREGKGRGPERSGEAPLVSLGSRAAGSGGCCGELEMGTALDIKIKRANKVYHAGEVLSGVVVISSKDSVQHQGVSLTMEGTVNLQLSAKSVGVFEAFYNSVKPIQIINSTIEMVKPGKFPSGKTEIPFEFPLHLKGNKVLYETYHGVFVNIQYTLRCDMKRSLLAKDLTKTCEFIVHSAPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 11072 - protein, 124 aa, Human
SLVPALKEVVVLWRRQMVLYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 11073 - protein, 1802 aa, Human
VFSLLNEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGDDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 11074 - protein, 510 aa, Human
HIEHSRYLSLLDAVDNSKMALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 11075 - protein, 541 aa, Human
LSRGCRTGRDRLGWARPPGPAVGMGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 11076 - protein, 787 aa, Human
TCAMEGDGGTPWALALLRTFDAGEFTGWEKVGSGGFGQVYKVRHVHWKTWLAIKCSPSLHVDDRERMELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAVTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 11077 - protein, 813 aa, Human
LLHFSSKPSVSVGPKCSVFHADCPVSRNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 11078 - protein, 386 aa, Human
ISSYEAEPKRTMATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQCSAPGPSTPPHTGSRRCS

SEQ ID NO: 11079 - protein, 125 aa, Human
MGRRDAQLLAALLVLGLCALAGSEKPSPCQCSRLSPHNRTNCGFPGITSDQCFDNGCCFDSSVTGVPWCFHPLPKQESDQCVMEVSDRRNCGYPGISPEECASRKCCFSNFIFEVPWCFFPKSVE

SEQ ID NO: 11080 - protein, 97 aa, Human
SLTRGRLWSREEAMATMENKVICALVLVSMLALGTLAEAQTETCTVAPRERQNCGFPGVTPSQCANKGCCFDDTVRGVPWCFYPNTIDVPPEEECEF

SEQ ID NO: 11081 - protein, 521 aa, Human
TGHRTARVLSFLIRSCPCEPGKGCVYGKPVTLWPTISSVVPSTFLGLGNYEVEVEAEPDVRGPEIVTMGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 11082 - protein, 521 aa, Human; identical to SEQ ID NO: 11081

SEQ ID NO: 11083 - protein, 521 aa, Human; identical to SEQ ID NO: 11081

SEQ ID NO: 11084 - protein, 665 aa, Human
GQEEMAAGETQLYAKVSNKLKSRSSPSLLEPLLAMGFPVHTALKALAATGRKTAEEALAWLHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLAGTSVSRFWIFSQVPGHGPNLRLSNLTRASFVSHYILQKYCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 11085 - protein, 613 aa, Human
RGGWRRESTVKSPSAAAGRRMGSGSSSYRPKAIYLDIDGRIQKVIFSKYCNSSDIMDLFCIATGLPRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 11086 - protein, 568 aa, Human
RRHTGQARSSAYFSPAEILSQSARTEGSCLGIRADIKLEKFQDRNSLRQSRNPQKYFAMDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTGITSR

SEQ ID NO: 11087 - protein, 568 aa, Human; identical to SEQ ID NO: 11086

SEQ ID NO: 11088 - protein, 568 aa, Human; identical to SEQ ID NO: 11086

SEQ ID NO: 11089 - protein, 594 aa, Human
AGWCPPAQRWRSRCPWNLGLTPSSGPGGTSCATFASTASWRRYGQGRASSPPTSWGPTRTSRGSRHVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 11090 - protein, 437 aa, Human
TMMATQTLSIDSYQDGQQMQVVTELKTEQDPNCSEPDAEGVSPPPVESQTPMDVDKQAIYRHPLFPLLALLFEKCEQSTQGSEGTTSASFDVDIENFVRKQEKEGKPFFCEDPETDNLMVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 11091 - protein, 196 aa, Human
TLRCPEAPLTPASLQVPVVPKLNMDVTIQHPWFKRTLGPFYPSRLFDQFFGEGLFEYDLLPFLSSTISPYYRQSLFRTVLDSGISEVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 11092 - protein, 250 aa, Human
VDGSGGGGWEMAEYLASIFGTEKDKVNCSFYFKIGACRHGDRCSRLHNKPTFSQTIALLNIYRNPQNSSQSADGLRCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 11093 - protein, 352 aa, Human
GVRGRADAQANGAEAAAAMGEAGAAEEACRHMGTKEEFVKVRKKDLERLTTEVMQIRDFLPRILNGEVLESFQKLKIVEKNLERKEQELEQLKMDCEHFKARLETVQADNIREKKEKLALRQQLNEAKQQLLQQAEYCTEMGAAACTLLWGVSSSEEVVKAILGGDKALKFFSITGQTMESFVKSLDGDVQELDSDESQFVFALAGIVTNVAAIACGREFLVNSSRVLLDTILQLLGDLKPGQCTKLKVLMLMSLYNVSINLKGLKYISESPGFIPLLWWLLSDPDAEVCLHVLRLVQSVVLEPEVFSKSASEFRSSLPLQRILAMSKSRNPRLQTAAQELLEDLRTLEHNV

SEQ ID NO: 11094 - protein, 314 aa, Human
PGMEEECRVLSIQSHVIRGYVGNRAATFPLQVLGFEIDAVNSVQFSNHTGYAHWKGQVLNSDELQELYEGLRLNNMNKYDYVLTGYTRDKSFLAMVVDIVQELKQQNPRLVYVCDPVLGDKWDGEGSMYVPEDLLPVYKEKVVPLADIITPNQFEAELLSGRKIHSQEEALRVMDMLHSMGPDTVVITSSDLPSPQGSNYLIVLGSQRRRNPAGSVVMERIRMDIRKVDAVFVGTGDLFAAMLLAWTHKHPNNLKVACEKTVSTLHHVLQRTIQCAKAQAGEGVRPSPMQLELRMVQSKRDIEDPEIVVQATVL

SEQ ID NO: 11095 - protein, 130 aa, Human
PARHVTPAPTWAEEPPRPLAESPRQIPSVAAKMMCGAPSATQPATAETQHIADQVRSQLEEKENKKFPVFKAVSFKSQVVAGTNYFIKVHVGDEDFVHLRVFQSLPHENKPLTLSNYQTNKAKHDELTYF

SEQ ID NO: 11096 - protein, 798 aa, Human
RRGAGGGSASWARVSAAAMAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 11097 - protein, 417 aa, Human
EHGVWSRLYPLLSAGPVGGPGAPAIARRSRIHWECHAHLSSPAWFLNGVEAVSGETSLGLAPLPCEEGFMWLVYSSGAPGTQQPARNRVFFPIGMAPGGVCWRPDGWGTGGQGRISGPGSMGAGQRLGSSGTQRCCWGSCFGKEVALRRVLHPSPVCMGVSCLCQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 11098 - protein, 417 aa, Human; identical to SEQ ID NO: 11097

SEQ ID NO: 11099 - protein, 133 aa, Human
LRRESGGAESVTRPLRAASPAPPPRAARAAMSEEKPKEGVKTENDHINLKVAGQDGSVVQFKIKRHTPLSKLMKAYCERQGLSMRQIRFRFDGQPINETDTPAQLEMEDEDTIDVFQQQTGGVPESSLAGHSF

SEQ ID NO: 11100 - protein, 1529 aa, Human
NPSVASWREDCPEGSRPGCSWRGGLRMEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 11101 - protein, 224 aa, Human
ISICQEMPSLEVITLSVNSISTLEPVSRCQRLSELYLRRNRIPSLAELFYLKGLPRLRVLWLAENPCCGTSPHRYRMTVLRTLPRLQKLDNQAVTEEELSRALSEGEEITAAPEREGTGHGGPKLCCTLSSLSSAAETGRDPLDSEEEATSGAQDERGLKPPSRGQFPSLSARDASSSHRGRNVLTAILLLLRELDAEGLEAVQQTVGSRLQALRGEEVQEHAE

SEQ ID NO: 11102 - protein, 144 aa, Human
PAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 11103 - protein, 412 aa, Human
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 11104 - protein, 1939 aa, Human
MSSDSEMAIFGEAAPFLRKSERERIEAQNKPFDAKTSVFVVDPKESFVKATVQSREGGKVTAKTEAGATVTVKDDQVFPMNPPKYDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEVTSGKMQGTLEDQIISANPLLEAFGNAKTVRNDNSSRFGKFIRIHFGTTGKLASADIETYLLEKSRVTFQLKAERSYHIFYQIMSNKKPDLIEMLLITTNPYDYAFVSQGEITVPSIDDQEELMATDSAIEILGFTSDERVSIYKLTGAVMHYGNMKFKQKQREEQAEPDGTEVADKAAYLQNLNSADLLKALCYPRVKVGNEYVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYEQHLGKSNNFQKPKPAKGKPEAHFSLIHYAGTVDYNIAGWLDKNKDPLNETVVGLYQKSAMKTLALLFVGATGAEAEAGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGLLEEMRDEKLAQLITRTQAMCRGFLARVEYQKMVERRESIFCIQYNVRAFMNVKHWPWMKLYFKIKPLLKSAETEKEMANMKEEFEKTKEELAKTEAKRKELEEKMVTLMQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKIRMDLERAKRKLEGDLKLAQESTMDIENDKQQLDEKLKKKEFEMSGLQSKIEDEQALGMQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNMETVSKAKGNLEKMCRALEDQLSEIKTKEEEQQRLINDLTAQRARLQTESGEYSRQLDEKDTLVSQLSRGKQAFTQQIEELKRQLEEEIKAKSALAHALQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERTNAACAALDKKQRNFDKILAEWKQKCEETHAELEASQKESRSLSTELFKIKNAYEESLDQLETLKRENKNLQQEISDLTEQIAEGGKRIHELEKIKKQVEQEKSELQAALEEAEASLEHEEGKILRIQLELNQVKSEVDRKIAEKDEEIDQMKRNHIRIVESMQSTLDAEIRSRNDAIRLKKKMEGDLNEMEIQLNHANRMAAEALRNYRNTQAILKDTQLHLDDALRSQEDLKEQLAMVERRANLLQAEIEELRATLEQTERSRKIAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVEAVKGLRKHERKVKELTYQTEEDRKNILRLQDLVDKLQAKVKSYKRQAEEAEEQSNVNLSKFRRIQHELEEAEERADIAESQVNKLRVKSREVHTKIISEE

SEQ ID NO: 11105 - protein, 415 aa, Human
KPGMVPPPPGEESQTVILPPGWQSYLSPQGRRYYVNTTTNETTWERPSSSPGIPASPGSHRSSLPPTVNGYHASGTPAHPPETAHMSVRKSTGDSQNLGSSSPSKKQSKENTITINCVTFPHPDTMPEQQLLKPTEWSYCDYFWADKKDPQGNGTVAGFELLLQKQLKGKQMQKEMSEFIRERIKIEEDYAKNLAKLSQNSLASQEEGSLGEAWAQVKKSLADEAEVHLKFSAKLHSEVEKPLMNFRENFKKDMKKCDHHIADLRKQLASRYASVEKARKALTERQRDLEMKTQQLEIKLSNKTEEDIKKARRKSTQAGDDLMRCVDLYNQAQSKWFEEMVTTTLELERLEVERVEMIRQHLCQYTQLRHETDMFNQSTVEPVDQLLRKVDPAKDRELWVREHKTGNIRPVDMEI

SEQ ID NO: 11106 - protein, 415 aa, Human; identical to SEQ ID NO: 11105

SEQ ID NO: 11107 - protein, 226 aa, Human
AQPAARGPRTSHPPSDSPAAAHSSSLMGNSKSGALSKEILEELQLNTKFSEEELCSWYQSFLKDCPTGRITQQQFQSIYAKFFPDTDPKAYAQHVFRSFDSNLDGTLDFKEYVIALHMTTAGKTNQKLEWAFSLYDVDGNGTISKNEVLEIVMAIFKMITPEDVKLLPDDENTPEKRAEKIWKYFGKNDDDKLTEKEFIEGTLANKEILRLIQFEPQKVKEKMKNA

SEQ ID NO: 11108 - protein, 553 aa, Human
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 11109 - protein, 878 aa, Human
KTGNMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 11110 - protein, 395 aa, Human
QLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 11111 - protein, 391 aa, Human
FLRKYLVTNMTEFWLISAPGEKTCQQTWEKLHAATSKNNNLAVTSKFNIPDLKVGTLDVLVGLSDELAKLDAFVEGVVKKVAQYMADVLEDSKDKVQENLLANGVDLVTYITRFQWDMAKYPIKQSLKNISEIIAKGVTQIDNDLKSRASAYNNLKGNLQNLERKNAGSLLTRSLAEIVKKDDFVLDSEYLVTLLVVVPKLNHNDWIKQYETLAEMVVPRSSNVLSEDQDSYLCNVTLFRKAVDDFRHKARENKFIVRDFQYNEEEMKADKEEMNRLSTDKKKQFGPLVRWLKVNFSEAFIAWIHVKALRVFVESVLRYGLPVNFQAMLLQPNKKTLKKLREVLHELYKHLDSSAAAIIDAPMDIPGLNLSQQEYYPYVYYKIDCNLLEFK

SEQ ID NO: 11112 - protein, 1045 aa, Human
GIQYRGAGLGPLQQVLGANAAYKAALPGSRSATSTGASCTAGPVSRSSRACAFLTRSGTLKPVITASFWQTRSSAAGGRMVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPSWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 11113 - protein, 192 aa, Human; identical to SEQ ID NO: 8959

SEQ ID NO: 11114 - protein, 117 aa, Human
LFPTGPQSRHAQLPPATLPNSLRSLESPRSALDVASQSMLLRRLWEVASLGTRPVSAVPSVGRVWSPQMSLTKMGNFIAKFAMPKILAPRVLGLEALHNKWKRKNEEVRRFSDFLRA

SEQ ID NO: 11115 - protein, 192 aa, Human
LPCFLFVIMLQMAGQCSQNEYFDSLLHACIPCQLRCSSNTPPLTCQRYCNASVTNSVKGTNAILWTCLGLSLIISLAVFVLMFLLRKISSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 11116 - protein, 362 aa, Human
FGFPSCILRLIAGPGSCRGGGPIAMEYFMVPTQKVPSLQHFRKTEKEVIGGLCSLANIPLTPETQRDQERRIRREIANSNERRRMQSINAGFQSLKTLIPHTDGEKLSKAAILQQTAEYIFSLEQEKTRLLQQNTQLKRFIQELSGSSPKRRRAEDKDEGIGSPDIWEDEKAEDLRREMIELRQQLDKERSVRMMLEEQVRSLEAHMYPEKLKVIAQQVQLQQQQEQVRLLHQEKLEREQQQLRTQLLPPPAPTHHPTVIVPAPPPPPSHHINVVTMGPSSVINSVSTSRQNLDTIVQAIQHIEGTQEKQELEEEQRRAVIVKPVRSCPEAPTSDTASDSEASDSDAMDQSREEPSGDGELP

SEQ ID NO: 11117 - protein, 683 aa, Human
ARTPVCSMDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 11118 - protein, 188 aa, Human
QHIPLWALNVTPRLDSPCPVKMLVLLAFIIAFHITSAALLFIATVDNAWWVGDEFFADVWRICTNNTNCTVINDSFQEYSTLQAVQATMILSTILCCIAFFIFVLQLFRLKQGERFVLTSIIQLMSCLCVMIAASIYTDRREDIHDKNAKFYPVTREGSYGYSYILAWVAFACTFISGMMYLILRKRK

SEQ ID NO: 11119 - protein, 260 aa, Human
QMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 11120 - protein, 454 aa, Human
QAPTPTAFLPRARGARATPGPRQATDPAQRPAPGAGPAAELRGGTMQVTLKTLQQQTFKIDIDPEETVKALKEKIESEKGKDAFPVAGQKLIYAGKILNDDTALKEYKIDEKNFVVVMVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMGIPGDRESQAVVDPPQAASTGAPQSSAVAAAAATTTATTTTTSSGGHPLEFLRNQPQFQQMRQIIQQNPSLLPALLQQIGRENPQLLQQISQHQEHFIQMLNEPVQEAGGQGGGGGGGSGGIAEAGSGHMNYIQVTPQEKEAIERLKALGFPEGLVIQAYFACEKNENLAANFLLQQNFDED

SEQ ID NO: 11121 - protein, 315 aa, Human
GRIRQALREGCDCCALGASSLQGVMGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 11122 - protein, 315 aa, Human; identical to SEQ ID NO: 11121

SEQ ID NO: 11123 - protein, 480 aa, Human
LYFGTTNRPYHFHNLLAKVMQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 11124 - protein, 301 aa, Human
APSLAEARVRRSPGKRRLRRPKRRSRETADKQRRRRRRRRTQRGAAKEAVVVGVVAMAAAIASSLIRQKRQAREREKSNACKCVSSPSKGKTSCDKNKLNVFSRVKLFGSKKRRRRRPEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 11125 - protein, 117 aa, Human
LSPPRGACRMKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 11126 - protein, 887 aa, Human [sequence omitted]

SEQ ID NO: 11127 - protein, 251 aa, Human
GDVTHSAISELRESATAAASASSESAGSGPRMKSVIYHALSQKEANDSDVQPSGAQRAEAFVRAFLKRSTPRMSPQAREDQLQRKAVVLEYFTRHKRKEKKKKAKGLSARQRRELRLFDIKPEQQRYSLFLPLHELWKQYIRDLCSGLKPDTQPQMIQAKLLKADLHGAIISVTKSKCPSYVGITGILLQETKHIFKIITKEDRLKVIPKLNCVFTVETDGFISYIYGSKFQLRSSERSAKKFKAKGTIDL

SEQ ID NO: 11128 - protein, 622 aa, Human
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPVEYPLQLLHSPPAPVVKRPGAMATHHPLQEPSQPLNLTAKPKAPELPNTSSSPSLKMSSCVPRPPSHGGPTRDLQSSPPSLPLGFLGEGDAVTKAIQDARQLLHSHSGALDGSPNTPFRKDLISLDSSPAKERLEDGCVHPLEEAMLSCDMDGSRHFPESRNSSHIKRPMNAFMVWAKDERRKILQAFPDMHNSSISKILGSRWKSMTNQEKQPYYEEQARLSRQHLEKYPDYKYKPRPKRTCIVEGKRLRVGEYKALMRTRRQDARQSYVIPPQAGQVQMSSSDVLYPRAAGMPLAQPLVEHYVPRSLDPNMPVIVNTCSLREEGEGTDDRHSVADGEMYRYSEDEDSEGEEKSDGELVVLTD

SEQ ID NO: 11129 - protein, 760 aa, Human
RLSIGAMGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKEDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDDELKSSMLKNKEDEKIRSSVEKENQKSKGQENDHVHEKNKKFDHESSPGTDEDKSG

SEQ ID NO: 11130 - protein, 151 aa, Human
DSYRKQVVIDGETCLLDILDTAGQEEYSAMRDQYMRTGEGFLCVFAINNTKSFEDIHHYREQIKRVKDSEDVPMVLVGNKCDLPSRTVDTKQAQDLARSYGIPFIETSAKTRQGVDDAFYTLVREIRKHKEKMSKDGKKKKKKSKTKCVIM

SEQ ID NO: 11131 - protein, 487 aa, Human
VWRKHYVDGEFASSSVSTGATPPPTRPAALPFLFCRVMAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIRINSTAPFEEQENYFLLCDVLPEDRILREELQKQRLREILEQQQQERNDTNFHGVCMFCNEEFLGNRSVILNHMAREHAFNIGLPDNIVNCNEFLCTLQKKLDNLQCLYCEKTFRDKNTLKDHMRKKQHRKINPKNREYDRFYVINYLELGKSWEEVQLEDDRELLDHQEDDWSDWEEHPASAVCLFCEKQAETIEKLYVHMEDAHEFDLLKIKSELGLNFYQQVKLVNFIRRQVHQCRCYGCHVKFKSKADLRTHMEETKHTSLLPDRKTWDQLEYYFPTYENDTLLCTLSDSESDLTAQEQNENVPIISEDTSKLYALKQSSILNQLLL

SEQ ID NO: 11132 - protein, 372 aa, Human
RSLRRYGELANTPFGLFLPPCFCVPWECCCAYASGLFLELQWTGICDSTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 11133 - protein, 496 aa, Human
SPHPLSGRPPARRLLRAPASLARAVTMSQAYSSSQRVSSYRRTFGGAPGFPLGSPLSSPVFPRAGFGSKGSSSSVTSRVYQVSRTSGGAGGLGSLRASRLGTTRTPSSYGAGELLDFSLADAVNQEFLTTRTNEKVELQELNDRFANYIEKVRFLEQQNAALAAEVNRLKGREPTRVAELYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 11134 - protein, 367 aa, Human
AMVLHLLLFLLLTPQGGHSCQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 11135 - protein, 670 aa, Human
DDNMDTKSILEELLLKRSQQKKKMSPNNYKERLFVLTKTNLSYYEYDKMKRGSRKGSIEIKKIRCVEKVNLEEQTPVERQYPFQIVYKDGLLYVYASNEESRSQWLKALQKEIRGNPHLLVKYHSGFFVDGKFLCCQQSCKAAPGCTLWEAYANLHTAVNEEKHRVPTFPDRVLKIPRAVPVLKMDAPSSSTTLAQYDNESKKNYGSQPPSSSTSLAQYDSNSKKIYGSQPNFNMQYIPREDFPDWWQVRKLKSSSSSEDVASSNQKERNVNHTTSKISWEFPESSSSEEEENLDDYDWFAGNISRSQSEQLLRQKGKEGAFMVRNSSQVGMYTVSLFSKAVNDKKGTVKHYHVHTNAENKLYLAENYCFDSIPKLIHYHQHNSAGMITRLRHPVSTKANKVPDSVSLGNGIWELKREEITLLKELGSGQFGVVQLGKWKGQYDVAVKMIKEGSMSEDEFFQEAQTMMKLSHPKLVKFYGVCSKEYPIYIVTEYISNGCLLNYLRSHGKGLEPSQLLEMCYDVCEGMAFLESHQFIHRDLAARNCLVDRDLCVKVSDFGMTRYVLDDQYVSSVGTKFPVKWSAPEVFHYFKYSSKSDVWAFGILMWEVFSLGKQPYDLYDNSQVVLKVSQGHRLYRPHLASDTIYQIMYSCWHEATSRKASHISATPVFH

SEQ ID NO: 11136 - protein, 294 aa, Human
MSPINMNRQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 11137 - protein, 426 aa, Human
PEAGLFSCSEQSDFPEHIFIMIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 11138 - protein, 480 aa, Human
IWTINRHFVLASFWNHFGIFSTSNTETGMNRQLVNILTALFAFFLETNHFRTAFCKDHDSRSGKQPSQTLSPSDFLDKLMGRTSGYDARIRPNFKGPPVNVTCNIFINSFGSVTETTMDYRVNIFLRQQWNDSRLAYSEYPDDSLDLDPSMLDSIWKPDLFFANEKGANFHDVTTDNKLLRISKNGKVLYSIRLTLTLSCPMDLKNFPMDVQTCTMQLESFGYTMNDLIFEWLSDGPVQVAEGLTLPQFILKEEKELGYCTKHYNTGKFTCIEVKFHLERQMGYYLIQMYIPSLLIVILSWVSFWINMDAAPARVALGITTVLTMTTQSSGSRASLPKVSYVKAIDIWMAVCLLFVFAALLEYAAVNFVSRQHKEFLRLRRRQKRQNKEEDVTRESRFNFSGYGMGHCLQVKDGTAVKATPANPLPQPPKDGDAIKKKFVDRAKRIDTISRAAFPLAFLIFNIFYWITYKIIRHEDVHKK

SEQ ID NO: 11139 - protein, 375 aa, Human
DEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 11140 - protein, 201 aa, Human
KMAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYP

SEQ ID NO: 11141 - protein, 409 aa, Human
AAPRPRSLPMASPLRSAAALARQDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQVKYGREESDWTIVLS

SEQ ID NO: 11142 - protein, 164 aa, Human
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRSPRRRSFSRSRSRSLSRDRRRERSLSRERNHKPSRSFSRSRSRSRSNERK

SEQ ID NO: 11143 - protein, 929 aa, Human
PSTRVQFRWKMKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 11144 - protein, 296 aa, Human [sequence omitted]

SEQ ID NO: 11145 - protein, 522 aa, Human
VHEQQFAMESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVTIITSGAVVAEDSSVASLRHQQVALLATANGTHIAVQLEEQQTLEEAINVATAAMQQGAVTLETTVSESGC

SEQ ID NO: 11146 - protein, 643 aa, Human [sequence omitted]

SEQ ID NO: 11147 - protein, 299 aa, Human
TEDKVSAVWANRISSCSLQPRTLIPAAPYRAARRFTMVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 11148 - protein, 608 aa, Human
LRIRSQPSKQKHPWLRMGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 11149 - protein, 608 aa, Human; identical to SEQ ID NO: 11148

SEQ ID NO: 11150 - protein, 608 aa, Human; identical to SEQ ID NO: 11148

SEQ ID NO: 11151 - protein, 608 aa, Human; identical to SEQ ID NO: 11148

SEQ ID NO: 11152 - protein, 810 aa, Human
GQRRFLAVKMLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 11153 - protein, 204 aa, Human
CPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQYVEDNLGVMSVGFLLSSPDDAVIWRGPKKNGMIKQFLRDVDWGEVDYLIVDTPPGTSDEHLSVVRYLATAHIDGAVIITTPQVRIVTKASLFSLTPQIPQPR

SEQ ID NO: 11154 - protein, 629 aa, Human
FLKTGLIGLLVLGHCLLESGRLSVLLLVPHFGENLKPTRADNLRLDRCHQRSLGTMWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 11155 - protein, 819 aa, Human
CLFPTTRALLSLIFGPKPMHHRMNEMNLSPVGMEQLTSSSVSNALPVSGSHLGLAASPTHSAIPAPGLPVAIPNLGPSLSSLPSALSLMLPMGIGDRGVMCGLPERNYTLPPPPYPHLESSYFRTILPGILSYLADRPPPQYIHPNSINVDGNTALSITNNPSALDPYQSNGNVGLEPGIVSIDSRSVNTHGAQSLHPSDGHEVALDTAITMENVSRVTSPISTDGMAEELTMDGVAGEHSQIPNGSRSHEPLSVDSVSNNLAADAVGHGGVIPMHGNGLELPVVMETDHIASRVNGMSDSALSDSIHTVAMSTNSVSVALSTSHNLASLESVSLHEVGLSLEPVAVSSITQEVAMGTGHVDVSSDSLSFVSPSLQMEDSNSNKENMATLFTIWCTLCDRAYPSDCPEHGPVTFVPDTPIESRARLSLPKQLVLRQSIVGAEVGVWTGETIPVRTCFGPLIGQQSHSMEVAEWTDKAVNHIWKIYHNGVLEFCIITTDENECNWMMFVRKARNREEQNLVAYPHDGKIFFCTSQDIPPENELLFYYSRDYAQQIGVPEHPDVHLCNCGKECNSYTEFKAHLTSHIHNHLPTQGHSGSHGPSHSKERKWKCSMCPQAFISPSKLHVHFMGHMGMKPHKCDFCSKAFSDPSNLRTHLKIHTGQKNYRCTLCDKSFTQKAHLESHMVIHTGEKNLKCDYCDKLFMRRQDLKQHVLIHTQERQIKCPKCDKLFLRTNHLKKHLNSHEGKRDYVCEKCTKAYLTKYHLTRHLKTCKGPTSSSSAPEEEEEDDSEEEDLADSVGTEDCRINSAVYSADESLSAHK

SEQ ID NO: 11156 - protein, 115 aa, Human
YPTCQCCQLWKDHKAAVSSVNHQKTRDPRTVKVSTGRPFHLQSAHLWASRQATPLALYPELCLQAWQKSVPRGNMEELYDGQGPSLRTPEREVVQKPKTSWLCCFKESDFVPPCF

SEQ ID NO: 11157 - protein, 211 aa, Human
RSQTQREGLFAGWGGGFAMSDDDSRASTSSSSSSSSNQQTEKETNTPKKKESKVSMSKNSKLLSTSAKRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 11158 - protein, 714 aa, Human
HTRGGGLSCRRRRLCRRRECGVGTGAAAAATPGIFVASSRPFCPAAFPQSALPTPLRPGAPASISRSLSTTHTAPPIMDPGSGGGGGGGGGGGSSSGSSSSDSAPDCWDQADMEAPGPGPCGGGGSLAAAAEAQRENLSAAFSRQLNVNAKPFVPNVHAAEFVPSFLRGPAAPPPPAGGAPNNHGAGSGAGGRAAPVESSQEEQSLCEGSNSAVSMELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 11159 - protein, 1086 aa, Human
PSPFAFTLSKVNMSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSSYFNHYRSHHNLIHGLKPHFKLFHPSSESEQGLTRPHADTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 11160 - protein, 139 aa, Human
LDSSHCCSCSTALFRTQTTAAAVPRMVIRVYIASSSGSTAIKKKQQDVLGFLEANKIGFEEKDIAANEENRKWMRENVPENSRPATGYPLPPQIFNESQYRGDYDAFFEARENNAVYAFLGLTAPPGSKEAEVQAKQQA

SEQ ID NO: 11161 - protein, 554 aa, Human
GRRDQPPVSSGRPPLWGLRGMMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 11162 - protein, 554 aa, Human; identical to SEQ ID NO: 11161

SEQ ID NO: 11163 - protein, 267 aa, Human
VERPFPVSLQFSSALGGGRCRASASSPRRARRRGQRPRHPAPRRPQAARPSAAPRARRFLSQRPAAAAAAQRAALMQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 11164 - protein, 267 aa, Human; identical to SEQ ID NO: 11163

SEQ ID NO: 11165 - protein, 738 aa, Human
GERESKEPAMNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 11166 - protein, 750 aa, Human
YSSAVQKFSQTLQSFQFDFIGDTLTDDEINIAESFKEFAELLNEVENERMMMVHNASDLLIKPLENFRKEQIGFTKERKKKFEKDGERFYSLLDRHLHLSSKKKESQLQEADLQVDKERHNFFESSLDYVYQIQEVQESKKFNIVEPVLAFLHSLFISNSLTVELTQDFLPYKQQLQLSLQNTRNHFSSTREEMEELKKRMKEAPQTCKLPGQPTIEGYLYTQEKWALGISWVKYYCQYEKETKTLTMTPMEQKPGAKQGPLDLTLKYCVRRKTESIDKRFCFDIETNERPGTITLQALSEANRRLWMEAMDGKEPIYHSPITKQQEMELNEVGFKFVRKCINIIETKGIKTEGLYRTVGSNIQVQKLLNAFFDPKCPGDVDFHNSDWDIKTITSSLKFYLRNLSEPVMTYRLHKELVSAAKSDNLDYRLGAIHSLVYKLPEKNREMLELLIRHLVNVCEHSKENLMTPSNMGVIFGPTLMRAQEDTVAAMMNIKFQNIVVEILIEHFGKIYLGPPEESAAPPVPPPRVTARRHKPITISKRLLRERTVFYTSSLDESEDEIQHQTPNGTITSSIEPPKPPQHPKLPIQRSGETDPGRKSPSRPILDGKLEPCPEVDVGKLVSRLQDGGTKITPKATNGPMPGSGPTKTPSFHIKRPAPRPLAHHKEGDADSFSKVRPPGEKPTIIRPPVRPPDPPCRAATPQKPEPKPDIVAGNAGEITSSVVASRTRFFETASRKTGSSQGRLPGDES

SEQ ID NO: 11167 - protein, 121 aa, Human
QKATLLFLVKMAGKQAVSASGKWLDGIRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 11168 - protein, 161 aa, Human
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 11169 - protein, 205 aa, Human
ADSRSPATAASPSAPALPVHSPQPPSAKPQRPLPSPMTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYVALTVILIILFLITVVGSTYYFCRWYRNRKSKEPKKEYERVTSGDPELPQV

SEQ ID NO: 11170 - protein, 622 aa, Human
SFSLLSTPHAFGTMKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 11171 - protein, 397 aa, Human
TKGEDPSELKEWGAASGQPRVNSQDWSGVKVPHLLPFCSLSCLFCLTTAIMPRGQKSKLRAREKRRKAREETQGLKVAHATAAEKEECPSSSPVLGDTPTSSPAAGIPQKPQGAPPTTTAAAAVSCTESDEGAKCQGEENASFSQATTSTESSVKDPVAWEAGMLMHFILRKYKMREPIMKADMLKVVDEKYKDHFTEILNGASRRLELVFGLDLKEDNPSGHTYTLVSKLNLTNDGNLSNDWDFPRNGLLMPLLGVIFLKGNSATEEEIWKFMNVLGAYDGEEHLIYGEPRKFITQDLVQEKYLKYEQVPNSDPPRYQFLWGPRAYAETTKMKVLEFLAKMNGATPRDFPSHYEEALRDEEERAQVRSSVRARRRTTATTFRARSRAPFSRSSHPM

SEQ ID NO: 11172 - protein, 397 aa, Human; identical to SEQ ID NO: 11171

SEQ ID NO: 11173 - protein, 354 aa, Human
SLENDGVCFTEQEWENLEDWQKELYRNVMESNYETLVSLKVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPSSSRTVGCPKQKSHRQVQLDQECGQGLKLKKDTSRPYECSECEITFRYKQQLATHLRSHSGWGSCTPEEPEESLRPRPRLKPQTKKAKLHQCDVCLRSFSCKVSLVTHQRCHLQEGPSAGQHVQERFSPNSLVALPGHIPWRKSRSSLICGYCGKSFSHPSDLVRHQRIHTGERPYSCTECEKSFVQKQHLLQHQKIHQRERGGLALEPGRPNGLL

SEQ ID NO: 11174 - protein, 217 aa, Human
GKETLDQHSLRCLYGPVAGPLHLIDMMKKEIFTRKSGTMTSWDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKECYPNQTLQFPTCCSIHSSGQPV

SEQ ID NO: 11175 - protein, 166 aa, Human
HGSMRRLLIPLALWLGAVGVGVAELTEAQRRGLQVALEEFHKHPPVQWAFQETSVESAVDTPFPAGIFVRLEFKLQQTSCRKRDWKKPECKVRPNGRKRKCLACIKLGSEDKVLGRLVHCPIETQVLREAEEHQETQCLRVQRAGEDPHSFYFPGQFAFSKALPRS

SEQ ID NO: 11176 - protein, 445 aa, Human
AKWRGSLRPMGLARALRRLSGALDSGDSRAGDEEEAGPGLCRNGWAPAPVQSPVGRRRGRFVKKDGHCNVRFVNLGGQGARYLSDLFTTCVDVRWRWMCLLFSCSFLASWLLFGLAFWLIASLHGDLAAPPPPAPCFSHVASFLAAFLFALETQTSIGYGVRSVTEECPAAVAAVVLQCIAGCVLDAFVVGAVMAKMAKPKKRNETLVFSENAVVALRDHRLCLMWRVGNLRRSHLVEAHVRAQLLQPRVTPEGEYIPLDHQDVDVGFDGGTDRIFLVSPITIVHEIDSASPLYELGRAELARADFELVVILEGMVEATAMTTQCRSSYLPGELLWGHRFEPVLFQRGSQYEVDYRHFHRTYEVPGTPVCSAKELDERAEQASHSLKSSFPGSLTAFCYENELALSCCQEEDEDDETEEGNGVETEDGAASPRVLTPTLALTLPP

SEQ ID NO: 11177 - protein, 300 aa, Human
RETFTMSGALDVLQMREEDVLKFLAAGTHLGGTNLDFQMEQYIYERKSDGIYIINLKRTWEKLLLAAHAIVAIENPADVSVISSRNTGQTAVLKFAAATGATPIAGRFTPGTFTNQIQAAFREPRLLVVTDPRADHQPLTEASYVNLPTIALCNTDSPLRYVDIAIPCNNKGAYSVGLMWWMLAREVLCMLGTISCEHPWEVMPDLYFYRDPEEIEKEEQAAAEKAVTKEEFQGEWTAPAPEFTAIQPEVADWSEGVQVPSVPIQQFPTEDWSSQPAMEDWSAAPTAQATEWVGATTDWS

SEQ ID NO: 11178 - protein, 427 aa, Human
GRVARARSVPCCGRWPLARLRRLSWRSKMAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKIPRYKGQGKKKTSGQKAGDKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 11179 - protein, 535 aa, Human
RLRAAKAARGEGGGRGVGARPAGSWSLEEAEGTMSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEGSTTVRKEIIRNKIRAIGKMARVFSILRQESESVLTLKGLTPTGTLPLGVLSGGKQTIETAIRGFSLQHKIRSFEEARGLDRINERMPPRKDSIHAGGPMKSVTSAHSHAAHRSDQGKKAHS

SEQ ID NO: 11180 - protein, 685 aa, Human
SPASEHSMAVKVQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFENVKEIFGQTIIHHHIPFNWDCEFIRLHFGHNRKKHLNYTEFTQFLQELQLEHARQAFALKDKSKSGMISGLDFSDIMVTIRSHMLTPFVEENLVSAAGGSISHQVSFSYFNAFNSLLNNMELVRKIYSTLAGTRKDVEVTKEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFRSSPQFGVTLVTYELLQRWFYIDFGGLKPAGSEPTPKSRIADLPPANPDHIGGYRLATATFAGIENKFGLYLPKFKSPSVAVVQPKAAVAATQ

SEQ ID NO: 11181 - protein, 297 aa, Human; identical to SEQ ID NO: 7016

SEQ ID NO: 11182 - protein, 717 aa, Human
KSSWEDQGRAAGSTQGRKMRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 11183 - protein, 257 aa, Human
IPVHLVSSSSNLERFTSRRAPGVGLYNLKTLLFFSSVQWVLIPTMAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEAQRLMKKEQNKIGVKLS

SEQ ID NO: 11184 - protein, 407 aa, Human
KKRMSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 11185 - protein, 1078 aa, Human
DVHFVKVIKPVSNWEVHFLLETLCNKIFPKGLPEEYSVAAMFRVRRNAKKERWFLWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKGEQGEKGDPALAGLNGENGLKGDLGPHGPPGPKGEKGDTGPPGPPALPGSLGIQGPQGPPGKEGQRGRRGKTGPPGKPGPPGPPGPPGIQGIHQTLGGYYNKDNKGNDEHEAGGLKGDKGETGLPGFPGSVGPKGQKGEPGEPFTKGEKGDRGEPGVIGSQGVKGEPGDPGPPGLIGSPGLKGQQGSAGSMGPRGPPGDVGLPGEHGIPGKQGIKGEKGDPGGIIGPPGLPGPKGEAGPPGKSLPGEPGLDGNPGAPGPRGPKGERGLPGVHGSPGDIGPQGIGIPGRTGAQGPAGEPGIQGPRGLPGLPGTPGTPGNDGVPGRDGKPGLPGPPGDPIALPLLGDIGALLKNFCGNCQASVPGLKSNKGEEGGAGEPGKYDSMARKGDIGPRGPPGIPGREGPKGSKGERGYPGIPGEKGDEGLQGIPGIPGAPGPTGPPGLMGRTGHPGPTGAKGEKGSDGPPGKPGPPGPPGIPFNERNGMSSLYKIKGGVNVPSYPGPPGPPGPKGDPGPVGEPGAMGLPGLEGFPGVKGDRGPAGPPGIAGMSGKPGAPGPPGVPGEPGERGPVGDIGFPGPEGPSGKPGINGKDGIPGAQGIMGKPGDRGPKGERGDQGIPGDRGSQGERGKPGLTGMKGAIGPMGPPGNKGSMGSPGHQGPPGSPGIPGIPADAVSFEEIKKYINQEVLRIFEERMAVFLSQLKLPAAMLAAQAYGRPGPPGKDGLPGPPGDPGPQGYRGQKGERGEPGIGLPGSPGLPGTSALGLPGSPGAPGPQGPPGPSGRCNPEDCLYPVSHAHQRTGGN

SEQ ID NO: 11186 - protein, 1604 aa, Human
DNYIKRQKKEKRAKICAVSSMTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEDELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMGRQVDELDIWSHTNDTIGSVRRCIVNRIKANVAHKKIELFVGGELIDSEDDRKLIGQLNLKDKSLITAKLTQINFNMPSSPDSSSDSSTASPGNHRNHYNDGPNLEVESCLPGVIMSVHPRYISFLWQVADLGSNLNMPPLRDGARVLMKLMPPDRTAVEKLRAVCLDHAKLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLVFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDIMLIPEMMYLDILINLKTSQH

SEQ ID NO: 11187 - protein, 129 aa, Human
GGQASALLPYSRAHCSLSPGATRSPNTMVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 11188 - protein, 81 aa, Human
PDSQPTEFHLLTGWLAQPRWCPALSIQAKPILHHGQVQMLSQPEPEQILPPETKKSQTKEAELPDTEESHEVLPPQVQTEM

SEQ ID NO: 11189 - protein, 522 aa, Human
PGVPVWPGGTEPVPGRPSREPGDRACAVGKPPLLPRDSDPGTVEASGRSPRPLREDPVGERARSPEASREVERNRAGSPGGAEPPSRLVRQRRAQENEPSGAEAHARVGGGCPVSPPGRPGGEERHRSRREGSTSRPAAAEDGRLSGSERSAAEEGEASFGEEAPRDPEVQSAPGKMARPGQRWLGKWLVAMVVWALCRLATPLAKNLEPVSWSSLNPKFLSGKGLVIYPKIGDKLDIICPRAEAGRPYEYYKLYLVRPEQAAACSTVLDPNVLVTCNRPEQEIRFTIKFQEFSPNYMGLEFKKHHDYYITSTSNGSLEGLENREGGVCRTRTMKIIMKVGQDPNAVTPEQLTTSRPSKEADNTVKMATQAPGSRGSLGDSDGKHETVNQEEKSGPGASGGSSGDPDGFFNSKVALFAAVGAGCVIFLLIIIFLTVLLLKLRKRHRKHTQQRAAALSLSTLASPKGGSGTAGTEPSDIIIPLRTTENNYCPHYEKVSGDYGHPVYIVQEMPPQSPANIYYKV

SEQ ID NO: 11190 - protein, 729 aa, Human
TANRLLGFGGGGEARQVRFEDYLREPAQGDLGCGSPPHRPPAPSSPEGPDTGQKKTLDKKDGRRMSFQKPKGTIEYTVESRDSLNSIALKFDTTPNELVQLNKLFSRAVVTGQVLYVPDPEYVSSVESSPSLSPNPDVHPTEATPSSTFTGIRPARVVSSTSEEEEAFTEKFLKINCKYITSGKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 11191 - protein, 287 aa, Human
LPLLCPAPGTRLFPLQCLRGGDGSTMDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 11192 - protein, 743 aa, Human
KKRPKRLRTGNMVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITKEEASGSSVTAEEAKKFLAPKDKPSGDTAAVFEEGGDVDDLLDMI

SEQ ID NO: 11193 - protein, 869 aa, Human
LSSGARGAEPGARAVFPETRPRQRGAAASPVPPPAAPLPAAAARMPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPGPQRSTLMPAAPGVSPKLHDLSPAAYTKGVASPGHCHLGLPQPAGEAPAVQDVPRPVATHPGSPGQPPPALLPQQ

SEQ ID NO: 11194 - protein, 289 aa, Human
LWTMNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTPFTCVSWMLLKAGWSESLFWKLNQWLMIHMFHCRMVLTYHMWWVCFWHWDGLVSSLYLPHLTLFLVGLALLTLIINPYWTHKKTQQLLNPVDWNFAQPEAKSRPEGNGQLLRKKRP

SEQ ID NO: 11195 - protein, 181 aa, Human
GTSAGAQTKGALCQLKVPTEKLPSPLPTMADEIDFTTGDAGASSTYPMQCSALRKNGFVVLKGRPCKIVEMSTSKTGKHGHAKVHLVGIDIFTGKKYEDICPSTHNMDVPNIKRNDYQLICIQDGYLSLLTETGEVREDLKLPEGELGKEIEGKYNAGEDVQVSVMCAMSEEYAVAIKPCK

SEQ ID NO: 11196 - protein, 441 aa, Human
LIPFKCVIIRKDCFGYLPACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESW

SEQ ID NO: 11197 - protein, 470 aa, Human
CGSSTPPASSSCPEASTHTRTCSSPSWARGPSTTSTRAPSMIIDFAIPQKGGSLIEAFETWRSWADPKVCCDYSLHVAVTWWSDQVKEEMKILVQDKGVNSFKMFMAYKDLYMVTDLELYEAFSRCKEIGAIAQVHAENGDLIAEGAKKMLALGITGPEGHELCRPEAVEAEATLRAITIASAVNCPLYIVHVMSKSAAKVIADARRDGKVVYGEPIAASLGTDGTHYWNKEWHHAAHHVMGPPLRPDPSTPDFLMNLLANDDLTTTGTDNCTFNTCQKALGKDDFTKIPNGVNGVEDRMSVIWEKGVHSGKMDENRFVAVTSTNAAKIFNLYPRKGRIAVGSDADIVIWDPKGTRGCRSCVAFSDNGSVYKTNMNLPLQCLANARVHMEESMVIFYFSSLTSFILCRTFSFLDVLSYFACGDQKADEPWGSISLTLDPFKKLVTFLSFFSCFIVFFFFFEKWKNILRVY

SEQ ID NO: 11198 - protein, 404 aa, Human
EMASQPPPPPKPWETRRIPGAGPGPGPGPTFQSADLGPTLMTRPGQPALTRVPPPILPRPSQQTGSSSVNTFRPAYSSFSSGYGAYGNSFYGGYSPYSYGYNGLGYNRLRVDDLPPSRFVQQAEESSRGAFQSIESIVHAFASVSMMMDATFSAVYNSFRAVLDVANHFSRLKIHFTKVFSAFALVRTIRYLYRRLQRMLGLRRGSENEDLWAESEGTVACLGAEDRAATSAKSWPIFLFFAVILGGPYLIWKLLSTHSDEVTDSINWASGEDDHVVARAEYDFAAVSEEEISFRAGDMLNLALKEQQPKVRGWLLASLDGQTTGLIPANYVKILGKRKGRKTVESSKVSKQQQSFTNPTLTKGATVADSLDEQEAAFESVFVETNKVPVAPDSIGKDGEKQDL

SEQ ID NO: 11199 - protein, 190 aa, Human
SGGAKPPAKMCKGLAALPHSCLERAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVNIDHFTKDITMKNLVEPSLSSFDMAQKRIHALMEKDSLPRFVRSEFYQELIK

SEQ ID NO: 11200 - protein, 232 aa, Human
AKYAQSRSHSSSCRISFLLANSKLLNKMCKGLAGLPASCLRSAKDMKHRLGFLLQKSDSCEHNSSHNKKDKVVICQRVSQEEVKKWAESLENLISHECGLAAFKAFLKSEYSEENIDFWISCEEYKKIKSPSKLSPKAKKIYNEFISVQATKEVNLDSCTREETSRNMLEPTITCFDEAQKKIFNLMEKDSYRRFLKSRFYLDLVNPSSCGAEKQKGAKSSADCASLVPQCA

SEQ ID NO: 11201 - protein, 612 aa, Human
LATMKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 11202 - protein, 327 aa, Human
MTMESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 11203 - protein, 686 aa, Human
RLSIWPRQASRLKPSAPNSFLTSYGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKGPSATNLIIGSIAGAILVAAIVLGGTGWGFKNVKKRRFDPTQQGPI

SEQ ID NO: 11204 - protein, 640 aa, Human
TEFCRIDKPLCHSEDEKLSFEAVRNIHKLMDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDEINLAKQEAQRLKELREGTENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 11205 - protein, 487 aa, Human
RSPHCCLTAHLTMASAARLTMMWEEVTCPICLDPFVEPVSIECGHSFCQECISQVGKGGGSVCPVCRQRFLLKNLRPNRQLANMVNNLKEISQEAREGTQGERCAVHGERLHLFCEKDGKALCWVCAQSRKHRDHAMVPLEEAAQEYQEKLQVALGELRRKQELAEKLEVEIAIKRADWKKTVETQKSRIHAEFVQQKNFLVEEEQRQLQELEKDEREQLRILGEKEAKLAQQSQALQELISELDRRCHSSALELLQEVIIVLERSESWNLKDLDITSPELRSVCHVPGLKKMLRTCAVHITLDPDTANPWLILSEDRRQVRLGDTQQSIPGNEERFDSYPMVLGAQHFHSGKHYWEVDVTGKEAWDLGVCRDSVRRKGHFLLSSKSGFWTIWLWNKQKYEAGTYPQTPLHLQVPPCQVGIFLDYEAGMVSFYNITDHGSLIYSFSECAFTGPLRPFFSPGFNDGGKNTAPLTLCPLNIGSQGSTDY

SEQ ID NO: 11206 - protein, 623 aa, Human
VPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 11207 - protein, 572 aa, Human
PRRPVSPPAPSSQWFLLQLPWAPRPVVQPVEPRLCPSPLGGPSARADTHSAGEGEASRGWCGTCRPQQRRRAKPRAGQTKEAARVGRHGRRRRSAAMAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 11208 - protein, 174 aa, Human
LFSRLSASTAAMSLLLLVVSALHILILILLFVATLDKSWWTLPGKESLNLWYDCTWNNDTKTWACSNVSENGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 11209 - protein, 1345 aa, Human
EAARRGPQAMRGAGGPRGPRGPAKMLLLLALACASPFPEEAPGPGGAGGPGGGLGGARPLNVALVFSGPAYAAEAARLGPAVAAAVRSPGLDVRPVALVLNGSDPRSLVLQLCDLLSGLRVHGVVFEDDSRAPAVAPILDFLSAQTSLPIVAVHGGAALVLTPKEKGSTFLQLGSSTEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLTVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGKLDAFIYDAAVLNYMARKDEGCKLVTIGSGKVFATTGYGIALHKGSRWKRPIDLALLQFLGDDEIEMLERLWLSGICHNDKIEVMSSKLDIDNMAGVFYMLLVAMGLSLLVFAWEHLVYWRLRHCLGPTHRMDFLLAFSRGMYSCCSAEAAPPPAKPPPPPQPLPSPAYPAPRPAPGPAPFVPRERASVDRWRRTKGAGPPGGAGLADGFHRYYGPIEPQGLGLGLGEARAAPRGAAGRPLSPPAAQPPQKPPPSYFAIVRDKEPAEPPAGAFPGFPSPPAPPAAAATAVGPPLCRLAFEDESPPAPARWPRSDPESQPLLGPGAGGAGGTGGAGGGAPAAPPPCRAAPPPCPYLDLEPSPSDSEDSESLGGASLGGLEPWWFADFPYPYAERLGPPPGRYWSVDKLGGWRAGSWDYLPPRSGPAAWHCRHCASLELLPPPRHLSCSHDGLDGGWWAPPPPPWAAGPLPRRRARCGCPRSHPHRPRASHRTPAAAAPHHHRHRRAAGGWDLPPPAPTSRSLEDLSSCPRAAPARRLTGPSRHARRCPHAAHWGPPLPTASHRRHRGGDLGTRRGSAHFSSLESEV

SEQ ID NO: 11210 - protein, 335 aa, Human
TREPGGRCQAMARPVSDRTPAPLLLGGPAGTPPGGGALLGLRSLLQGTSKPKEPASCLLKEKERKAALPAATTPGPGLETAGPADAPAGAVVGGGSPRGRPGPVPAPGLLAPLLWERTLPFGDVEYVDLDAFLLEHGLPPSPPPPGGPSPEPSPARTPAPSPGPGSCGSASPRSSPGHAPARAALGTASGHRAGLTSRDTPSPVDPDTVEVLMTFEPDPADLALSSIPGHETFDPRRHRFSEEELKPQPIMKKARKIQVPEEQKDEKYWSRRYKNNEAAKRSRDARRLKENQISVRAAFLEKENALLRQEVVAVRQELSHYRAVLSRYQAQHGAL

SEQ ID NO: 11211 - protein, 377 aa, Human
GSEEEVPCQGPSVATLRTPAPTSLLSLMASPPPFHSQKLPGEYFRYKGVPFPVGLYSLESISLAENTQDVRDDDIFIITYPKSGTTWMIEIICLILKEGDPSWIRSVPIWERAPWCETIVGAFSLPDQYSPRLMSSHLPIQIFTKAFFSSKAKVIYMGRNPRDVVVSLYHYSKIAGQLKDPGTPDQFLRDFLKGEVQFGSWFDHIKGWLRMKGKDNFLFITYEELQQDLQGSVERICGFLGRPLGKEALGSVVAHSTFSAMKANTMSNYTLLPPSLLDHRRGAFLRKGVCGDWKNHFTVAQSEAFDRAYRKQMRGMPTFPWDEDPEEDGSPDPEPSPEPEPKPSLEPNTSLEREPRPNSSPSPSPGQASETPHPRPS

SEQ ID NO: 11212 - protein, 226 aa, Human
RAPRRTHVTSRRRHSLEAFPAHPSPFSLSGPGRAGGAIMGVDIRHNKDRKVRRKEPKSQDIYLRLLVKLYRFLARRTNSTFNQVVLKRLFMSRTNRPPLSLSRMIRKMKLPGRENKTAVVVGTITDDVRVQEVPKLKVCALRVTSRARSRILRAGGKILTFDQLALDSPKGCGTVLLSGPRKGREVYRHFGKAPGTPHSHTKPYVRSKGRKFERARGRRASRGYKN

SEQ ID NO: 11213 - protein, 385 aa, Human
RADLSPWLLWHLGNWDSLWGGEESWKSWRDRVPEGGDRGAERGGQGVGQGSLGGLLGMGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 11214 - protein, 365 aa, Human
KAGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEIGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 11215 - protein, 411 aa, Human
RGGCDRDGPFSASSPLAMASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPGKLTRG

SEQ ID NO: 11216 - protein, 182 aa, Human
SSSPGPSSEQQTGLSVPQLAFTHSPCHHTDGTMKDEVALLAAVTLLGVLLQAYFSLQVISARRAFRVSPPLTTGPPEFERVYRAQVNCSEYFPLFLATLWVAGIFFHEGAAALCGLVYLFARLRYFQGYARSAQLRLAPLYASARALWLLVALAALGLLAHFLPAALRAALLGRLRTLLPWA

SEQ ID NO: 11217 - protein, 395 aa, Human
NLPTLRDIAGRCIMSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSAQMQQ

SEQ ID NO: 11218 - protein, 290 aa, Human
ARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFSCKGPGQNVAVTRAHPDSQGRRRRPERGARGGQVFYNSEYGELSEPSEEDHCSPSARVTFFTDNSY

SEQ ID NO: 11219 - protein, 351 aa, Human
LNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 11220 - protein, 790 aa, Human
PAKGKKKCSPHSCKGLQLATANRKIKMIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFGTSRHISVGPFPILSMMVGLAVSGAVSKAVPDRNATTLGLPNNSNNSSLLDDERVRVAAAASVTVLSGIIQLAFGILRIGFVVIYLSESLISGFTTAAAVHVLVSQLKFIFQLTVPSHTDPVSIFKVLYSVFSQIEKTNIADLVTALIVLLVVSIVKEINQRFKDKLPVPIPIEFIMTVIAAGVSYGCDFKNRFKVAVVGDMNPGFQPPITPDVETFQNTVGDCFGIAMVAFAVAFSVASVYSLKYDYPLDGNQELIALGLGNIVCGVFRGFAGSTALSRSAVQESTGGKTQIAGLIGAIIVLIVVLAIGFLLAPLQKSVLAALALGNLKGMLMQFAEIGRLWRKDKYDCLIWIMTFIFTIVLGLGLGLAASVAFQLLTIVFRTQFPKCSTLANIGRTNIYKNKKDYYDMYEPEGVKIFRCPSPIYFANIGFFRRKLIDAVGFSPLRILRKRNKALRKIRKLQKQGLLQVTPKGFICTVDTIKDSDEELDNNQIEVLDQPINTTDLPFHIDWNDDLPLNIEVPKISLHSLILDFSAVSFLDVSSVRGLKSILQEFIRIKVDVYIVGTDDDFIEKLNRYEFFDGEVKSSIFFLTIHDAVLHILMKKDYSTSKFNPSQEKDGKIDFTINTNGGLRNRVYEVPVETKF

SEQ ID NO: 11221 - protein, 377 aa, Human
NRESGLNKDAFPQYIHNMLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 11222 - protein, 387 aa, Human
GLNKDAFPQYIHNMLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 11223 - protein, 371 aa, Human
PTMTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 11224 - protein, 352 aa, Human
PRKRDLPGSSLPKMAAEDELQLPRLPELFETGRQLLDEVEVATEPAGSRIVQEKVFKGLDLLEKAAEMLSQLDLFSRNEDLEEIASTDLKYLLVPAFQGALTMKQVNPSKRLDHLQRAREHFINYLTQCHCYHVAEFELPKTMNNSAENHTANSSMAYPSLVAMASQRQAKIQRYKQKKELEHRLSAMKSAVESGQADDERVREYYLLHLQRWIDISLEEIESIDQEIKILRERDSSREASTSNSSRQERPPVKPFILTRNMAQAKVFGAGYPSLPTMTVSDWYEQHRKYGALPDQGIAKAAPEEFRKAAQQQEEQEEKEEEDDEQTLHRAREWDDWKDTHPRGYGNRQNMG

SEQ ID NO: 11225 - protein, 189 aa, Human
AEVSSLWSRSWARIRRGTEALRGGAMSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 11226 - protein, 408 aa, Human
HGPQVSFSVRSRPGLGLEPSWPSQMTWTSGQLQREKQARPGSGAVLAFPDDKDLRVYGPAESQSAVFGDVCPLLTSLLDGYNVCVMAYGQTGSGKSYTMLGRHSDDGPVLPLDPQSDLGIIPRVAEELFRLILENTSRSPKVEVSIVEVYNNDIFDLLAKDSIAAVSGVKREVVTAKDGRTEVALLASEAVGSASKLMELVHGGLQLRAKHPTLVHADSSRSHLIITVTLTTASCSDSTADQACSATLPREQTEAGRAGRSRRASQGALAPQLVPGNPAGHAEQVQARLQLVDSAGSECVGVSGVTGLALREMACISRSLAALAGVLGALLEHRGHAPYRNSRLTHLLQDCLGGDAKLLVILCISPSQRHLAQTLQGLGFGIRARQVQRGPARKKPPSSQTEGKRRPD

SEQ ID NO: 11227 - protein, 408 aa, Human; identical to SEQ ID NO: 11226

SEQ ID NO: 11228 - protein, 611 aa, Human
SSSLKINCLHIAFFAPKLFPLVVLRGDAQGAPPFKNWIMNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGWYNKSISRDKAEKLLLDTGKEGAFMVRDSRTAGTYTVSVFTKAVVSENNPCIKHYHIKETNDNPKRYYVAEKYVFDSIPLLINYHQHNGGGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 11229 - protein, 968 aa, Human
AQAPPGSACWRLPCSPSGRGRRGSLDGQVRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGLLQASAAPEGTPGKPSARPQEPPQARRCIPTAAPWCWPSAVPASGSTCPKEGMEDLQFENWGPVPKSVIVLTTCITALLDTQESHGNANWKGPLPQGSLRRRGSVESKPTFPKSPPTRPLTPSTVRLYVSGIQGNVNFLFIWEIVHGKQIFFSLVHLLIVYNICTSMQNT

SEQ ID NO: 11230 - protein, 262 aa, Human
VPRANVSCKVRLETGDMAAPGPALCLFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 11231 - protein, 246 aa, Human
LAAPPPPPLLRHRLPPPEQSARAPAGSVMATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 11232 - protein, 216 aa, Human
LAAGMKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 11233 - protein, 528 aa, Human
LRPRNPSVGGPEASLSRFKMERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 11234 - protein, 564 aa, Human
LCGAVSCTCLGIRREEAGTPGSQEMDSVAFEDVDVNFTQEEWALLDPSQKNLYRDVMWETMRNLASIGKKWKDQNIKDHYKHRGRNLRSHMLERLYQTKDGSQRGGIFSQFANQNLSKKIPGVKLCESIVYGEVSMGQSSLNRHIKDHSGHEPKEYQEYGEKPDTRNQCWKPFSSHHSFRTHEIIHTGEKLYDCKECGKTFFSLKRIRRHIITHSGYTPYKCKVCGKAFDYPSRFRTHERSHTGEKPYECQECGKAFTCITSVRRHMIKHTGDGPYKCKVCGKPFHSLSSFQVHERIHTGEKPFKCKQCGKAFSCSPTLRIHERTHTGEKPYECKQCGKAFSYLPSLRLHERIHTGEKPFVCKQCGKAFRSASTFQIHERTHTGEKPYECKECGEAFSCIPSMRRHMIKHTGEGPYKCKVCGKPFHSLSPFRIHERTHTGEKPYVCKHCGKAFVSSTSIRIHERTHTGEKPYECKQCGKAFSYLNSFRTHEMIHTGEKPFECKRCGKAFRSSSSFRLHERTHTGQKPYHCKECGKAYSCRASFQRHMLTHAEDGPPYKCMWESL

SEQ ID NO: 11235 - protein, 212 aa, Human
LLSAFFSPHPSLYLQPPMAPKKPEPKKDDAKAAPKAAPAPAPPPEPERPKEVEFDASKIKIEFTPEQIEEFKEAFMLFDRTPKCEMKITYGQCGDVLRALGQNPTQAEVLRVLGKPRQEELNTKMMDFETFLPMLQHISKNKDTGTYEDFVEGLRVFDKEGNGTVMGAELRHVLATLGERLTEDEVEKLMAGQEDSNGCINYEAFVKHIMSS

SEQ ID NO: 11236 - protein, 467 aa, Human
HHRWTPQLIVLPPGDPAPSRRVAAESPPSPRRPCVSDMAARLLRGSLRVLGGHRAPRQLPAARCSHSGGEERLETPSAKKLTDIGIRRIFSPEHDIFRKSVRKFFQEEVIPHHSEWEKAGEVSREVWEKAGKQGLLGVNIAEHLGGIGGDLYSAAIVWEEQAYSNCSGPGFSIHSGIVMSYITNHGSEEQIKHFIPQMTAGKCIGAIAMTEPGAGSDLQGIKTNAKKDGSDWILNGSKVFISNGSLSDVVIVVAVTNHEAPSPAHGISLFLVENGMKGFIKGRKLHKMGLKAQDTAELFFEDIRLPASALLGEENKGFYYIMKELPQERLLIADVAISASEFMFEETRNYVKQRKAFGKTVAHLQTVQHKLAELKTHICVTRAFVDNCLQLHEAKRLDSATACMAKYWASELQNSVAYDCVQLHGGWGYMWEYPIAKAYVDARVQPIYGGTNEIMKELIAREIVFDK

SEQ ID NO: 11237 - protein, 572 aa, Human
TAVPDPRAGAERAEAGAMEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 11238 - protein, 572 aa, Human; identical to SEQ ID NO: 11237

SEQ ID NO: 11239 - protein, 516 aa, Human
PARRPLYGGAALVAAAPRDSRARLRGGGAPRLQNPACSSGFGVLEEAATAARERKMLELRHRGSCPGPREAVSPPHREGEAAGGDHETESTSDKETDIDDRYGDLDSRTDSDIPEIPPSSDRTPEILKKALSGLSSRWKNWWIRGILTLTMISLFFLIIYMGSFMLMLLVLGIQVKCFHEIITIGYRVYHSYDLPWFRTLSWYFLLCVNYFFYGETVADYFATFVQREEQLQFLIRYHRFISFALYLAGFCMFVLSLVKKHYRLQFYMFAWTHVTLLITVTQSHLVIQNLFEGMIWFLVPISSVICNDITAYLFGFFFGRTPLIKLSPKKTWEGFIGGFFSTVVFGFIAAYVLSKYQYFVCPVEYRSDVNSFVTECEPSELFQLQTYSLPPFLKAVLRQERVSLYPFQIHSIALSTFASLIGPFGGFFASGFKRAFKIKDFANTIPGHGGIMDRFDCQYLMATFVHVYITSFIRGPNPSKVLQQLLVLQPEQQLNIYKTLKTHLIEKGILQPTLKV

SEQ ID NO: 11240 - protein, 150 aa, Human
SFWDWGRVCYGNSVCPQPLFVNKEGTEIREIKAEGSEREAMPAAWILWAHSHSELHTVMETPLEKALTTMVTTFHKYSGREGSKLTLSRKELKELIKKELCLGEMKESSIDDLMKSLDKNSDQEIDFKEYSVFLTMLCMAYNDFFLEDNK

SEQ ID NO: 11241 - protein, 131 aa, Human
TVEDRSPHTAPAATFATLAICPEPAPTSGPGQPCTAAMGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 11242 - protein, 110 aa, Human
WVCLCHLVCHRSMMCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 11243 - protein, 312 aa, Human [sequence omitted]

SEQ ID NO: 11244 - protein, 498 aa, Human
AMPTPDATTPQAKGFRRAVSELDAKQAEAIMSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 11245 - protein, 171 aa, Human
GGRAAPSASRTPEARVAAMARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSAADDLYSMLEEERQQRQSSDPRRGGVPSWFGL

SEQ ID NO: 11246 - protein, 361 aa, Human
KPQHVHPLQGSASTLWGPDYRLMAEASSDPGAEEREELLGPTAQWSVEDEEEAVHEQCQHERDRQLQAQDEEGGGHVPERPKQEMLLSLKPSEAPELDEDEGFGDWSQRPEQRQQHEGAQGTLDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGQTPKLARQASIELPSMAASSTKSWWETGEVQAQSAAKTPSCKDIVAGDMSKKSLWEQKGGSKTSSTIKSTPSGKRYKFVATGHGKYEKVLVEGGPAP

SEQ ID NO: 11247 - protein, 192 aa, Human
KCLLRLTSSPRPWTAKQLLSCLSWPTSTDQRQSKRRRLLAQAEKKAAGKGDAPTKRPPVLRAGVNTIATLVENKKAQLVVIAHDVDPIELVVFLPALCRKMGVPYCIIKGKARLGRLVHRKTCTTVGFTQVNSEDKDTLAKLVEAIRTNYNDRYRYDEIRCHWGSNVLGPKSVARIAKLEKAKAKELATKLG

SEQ ID NO: 11248 - protein, 911 aa, Human
TTPELRPCSCQLRFRRSMARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRTPVNLAVLKLSEQGILDKLKNKWWYDKGECGAKDSGSKDKTSALSLSNVAGVFYILVGGLGLAMMVALIEFCYKSRAESKRMKLTKNTQNFKPAPATNTQNYATYREGYNVYGTESVKI

SEQ ID NO: 11249 - protein, 168 aa, Human
GPRASAAGDPARGGAAPKMSQTAMSETYDFLFKFLVIGNAGTGKSCLLHQFIEKKFKDDSNHTIGVEFGSKIINVGGKYVKLQIWDTAGQERFRSVTRSYYRGAAGALLVYDITSRETYNALTNWLTDARMLASQNIVIILCGNKKDLDADREVTFLEASRFAQENGN

SEQ ID NO: 11250 - protein, 488 aa, Human
IGPRRQPLGRTGLRAPRAMAGENHQWQGSILYNMLMSAKQTRAAPEAPETRLVDQCWGCSCGDEPGVGREGLLGGRNVALLYRCCFCGKDHPRQGSILYSMLTSAKQTYAAPKAPEATLGPCWGCSCGSDPGVGRAGLPGGRPVALLYRCCFCGEDHPRQGSILYSLLTSSKQTHVAPAAPEARPGGAWWDRSYFAQRPGGKEALPGGRATALLYRCCFCGEDHPQQGSTLYCVPTSTNQAQAAPEERPRAPWWDTSSGALRPVALKSPQVVCEAASAGLLKTLRFVKYLPCFQVLPLDQQLVLVRNCWASLLMLELAQDRLQFETVEVSEPSMLQKILTTRRRETGGNEPLPVPTLQHHLAPPAEARKVPSASQVQAIKCFLSKCWSLNISTKEYAYLKGTVLFNPDVPGLQCVKYIQGLQWGTQQILSEHTRMTHQGPHDRFIELNSTLFLLRFINANVIAELFFRPIIGTVSMDDMMLEMLCTKI

SEQ ID NO: 11251 - protein, 403 aa, Human
PSACGEGSRQAAVMAVSESQLKKMVSKYKYRDLTVRETVNVITLYKDLKPVLDSYVFNDGSSRELMNLTGTIPVPYRGNTYNIPICLWLLDTYPYNPPICFVKPTSSMTIKTGKHVDANGKIYLPYLHEWKHPQSDLLGLIQVMIVVFGDEPPVFSRPISASYPPYQATGPPNTSYMPGMPGGISPYPSGYPPNPSGYPGCPYPPGGPYPATTSSQYPSQPPVTTVGPSRDGTISEDTIRASLISAVSDKLRWRMKEEMDRAQAELNALKRTEEDLKKGHQKLEEMVTRLDQEVAEVDKNIELLKKKDEELSSALEKMENQSENNDIDEVIIPTAPLYKQILNLYAEENAIEDTIFYLGEALRRGVIDLDVFLKHVRLLSRKQFQLRALMQKARKTAGLSDLY

SEQ ID NO: 11252 - protein, 351 aa, Human
CRWCIFLVSLLCLPSKVLQMSTVKEQLIEKLIEDDENSQCKITIVGTGAVGMACAISILLKDLADELALVDVALDKLKGEMMDLQHGSLFFSTSKITSGKDYSVSANSRIVIVTAGARQQEGETRLALVQRNVAIMKSIIPAIVHYSPDCKILVVSNPVDILTYIVWKISGLPVTRVIGSGCNLDSARFRYLIGEKLGVHPTSCHGWIIGEHGDSSVPLWSGVNVAGVALKTLDPKLGTDSDKEHWKNIHKQVIQSAYEIIKLKGYTSWAIGLSVMDLVGSILKNLRRVHPVSTMVKGLYGIKEELFLSIPCVLGRNGVSDVVKINLNSEEEALFKKSAETLWNIQKDLIF

SEQ ID NO: 11253 - protein, 351 aa, Human; identical to SEQ ID NO: 11252

SEQ ID NO: 11254 - protein, 122 aa, Human [sequence omitted]

SEQ ID NO: 11255 - protein, 489 aa, Human
KVKKLKLLEVNEPLVIKYCLHCATSFLARSLCFHTLVLENYSKFIMIEDNKENKDHSLERGRASLIFSLKNEVGGLIKALKIFQEKHVNLLHIESRKSKRRNSEFEIFVDCDINREQLNDIFHLLKSHTNVLSVNLPDNFTLKEDGMETVPWFPKKISDLDHCANRVLMYGSELDADHPGFKDNVYRKRRKYFADLAMNYKHGDPIPKVEFTEEEIKTWGTVFQELNKLYPTHACREYLKNLPLLSKYCGYREDNIPQLEDVSNFLKERTGFSIRPVAGYLSPRDFLSGLAFRVFHCTQYVRHSSDPFYTPEPDTCHELLGHVPLLAEPSFAQFSQEIGLASLGASEEAVQKLATCYFFTVEFGLCKQDGQLRVFGAGLLSSISELKHALSGHAKVKPFDPKITCKQECLITTFQDVYFVSESFEDAKEKMREFTKTIKRPFGVKYNPYTRSIQILKDTKSITSAMNELQHDLDVVSDALAKVSRKPSI

SEQ ID NO: 11256 - protein, 464 aa, Human
PAERPRMEREPSASEAAPAAAALFAWGANSYGQLGLGHKEDVLLPQQLNDFCKPRSVRRITGGGGHSAVVTDGGDLFVCGLNKDGQLGLGHTEDIPYFTPCKSLFGCPIQQVACGWDFTIMLTENGQVLSCGSNSFGQLGVPHGPRRCVVPQAIELHKEKVVCIAAGLRHAVAATASGIVFQWGTGLASCGRRLCPGQTLPLFFTAKEPSRVTGLENSKAMCVLAGSDHSASLTDAGEVYVWGSNKHGQLANEAAFLPVPQKIEAHCFQNEKVTAIWSGWTHLVAQTETGKMFTWGRADYGQLGRKLETYEGWKLEKQDSFLPCSRPPNSMPSSPHCLTGATEVSCGSEHNLAIIGGVCYSWGWNEHGMCGDGTEANVWAPKPVQALLSSSGLLVGCGAGHSLALCQLPAHPALVQDPKVTYLSPDAIEDTESQKAMDKERNWKERQSETSTQSQSDWSRNGGL

SEQ ID NO: 11257 - protein, 140 aa, Human
NFSWRKVHSTMRLFTGIVFCSLVMGVTSESWRSFFKEALQGVGDMGRAYWDIMISNHQNSNRYLYARGNYDAAQRGPGGVWAAKLISRSRVYLQGLIDYYLFGNSSTVLEDSKSNEKAEEWGRSGKDPDRFRPDGLPKKY

SEQ ID NO: 11258 - protein, 213 aa, Human
PGVQAAPSPACPAAATMTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 11259 - protein, 563 aa, Human
EIRTEGQEGEASPPRGGGDCSRQGPQRPRSGLAPPLHASRDPRGQPGRAGMPGLGRRAQWLCWWWGLLCSCCGPPPLRPPLPAAAAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 11260 - protein, 1003 aa, Human
SPSGRLPPASLRLRPGSERPELGKMRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 11261 - protein, 557 aa, Human
TRPALLSGRVRGLSTRPKGAGARAQPMAALGCARLRWALRGAGRGLCPHGARAKAAIPAALPSDKATGAPGAGPGVRRRQRSLEEIPRLGQLRFFFQLFVQGYALQLHQLQVLYKAKYGPMWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 11262 - protein, 327 aa, Human
PVAMASYYEILDVPRSASADDIKKAYRRKALQWHPDKNPDNKEFAEKKFKEVAEAYEVLSDKHKREIYDRYGREGLTGTGTGPSRAEAGSGGPGFTFTFRSPEEVFREFFGSGDPFAELFDDLGPFSELQNRGSRHSGPFFTFSSSFPGHSDFSSSSFSFSPGAGAFRSVSTSTTFVQGRRITTRRIMENGQERVEVEEDGQLKSVTINGVPDDLALGLELSRREQQPSVTSRSGGTQVQQTPASCPLDSDLSEDEDLQLAMAYSLSEMEAAGKKPAGGREAQHRRQGRPKAQHQDPGLGGTQEGARGEATKRSPSPEEKASRCLIL

SEQ ID NO: 11263 - protein, 523 aa, Human
RALSPLSSAAQHRKRPSALSPATPAGSRPLRRCAPGFAATKTQRVQRRPPRRFENMAKRNAEKELTDRNWDQEDEAEEVGTFSMASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 11264 - protein, 575 aa, Human
VDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATQKSKKGRQNTPAGSSKEDCRVLPWKQGLEDTHLDA

SEQ ID NO: 11265 - protein, 575 aa, Human; identical to SEQ ID NO: 11264

SEQ ID NO: 11266 - protein, 575 aa, Human; identical to SEQ ID NO: 11264

SEQ ID NO: 11267 - protein, 575 aa, Human; identical to SEQ ID NO: 11264

SEQ ID NO: 11268 - protein, 354 aa, Human
GMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 11269 - protein, 415 aa, Human
MSERRVVVDLPTSASSSMPLQRRRASFRGPRSSSSLESPPASRTNAMSGLVRAPGVYVGTAPSGCIGGLGARVTRRALGISSVFLQGLRSSGLATVPAPGLERDHGAVEDLGGCLVEYMAKVHALEQVSQELETQLRMHLESKATRSGNWGALRASWASSCQQVGEAVLENARLMLQTETIQAGADDFKERYENEQPFRKAAEEEINSLYKVIDEANLTKMDLESQIESLKEELGSLSRNYEEDVKLLHKQLAGCELEQMDAPIGTGLDDILETIRIQWERDVEKNRVEAGALLQAKQQAEVAHMSQTQEEKLAAALRVELHNTSCQVQSLQAETESLRALKRGLENTLHDAKHWHDMELQNLGAVVGRLEAELREIRAEAEQQQQERAHLLARKCQLQKDVASYHALLDREESG

SEQ ID NO: 11270 - protein, 157 aa, Human
PGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKGLSAAGAGAGRRLTG

SEQ ID NO: 11271 - protein, 157 aa, Human; identical to SEQ ID NO: 11270

SEQ ID NO: 11272 - protein, 184 aa, Human
GGRRQRRAQDVHYGSGLAAPVAAAPRAGALAGVAALRGRGASARHRPLLPRQLLERGPGQVHGLRVLQGATAQRLLPGLRCSTSCPLPAALAHPWGRSEPDLRAGAAFWLFGLETMPQEREVHHPHRGDRRRGLPSCGADPVTMCPLPAGARPLIIHSSILEPVSASQTRREPSSSNHKGGGGR

SEQ ID NO: 11273 - protein, 161 aa, Human
LSFRCLIAAIMGRMHAPGKGLSQSALPYRRSVPTWLKLTSDDVKEQIYKLAKKGLTPSQIGVILRDSHGVAQVRFVTGNKILRILKSKGLAPDLPEDLYHLIKKAVAVRKHLERNRKDKDAKFRLILIESRIHRLARYYKTKRVLPPNWKYESSTASALVA

SEQ ID NO: 11274 - protein, 154 aa, Human
LVPGCSSSGISLAQFSSSACPRVHQAMDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGTTGIREDPDVCLKAP

SEQ ID NO: 11275 - protein, 1092 aa, Human
ARSVQACFCGFLESLVTLRRITFTFAFILGNHYQMRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 11276 - protein, 689 aa, Human
MAAATASPRSLLVLLQVVVLALAQIRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 11277 - protein, 773 aa, Human
PSGPRGRRPAADWTRAAPPPGRRGTRRTETMEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPGWVAGSW

SEQ ID NO: 11278 - protein, 668 aa, Human [sequence omitted]

SEQ ID NO: 11279 - protein, 506 aa, Human
QCQAGGGSGWRLRPALQRGLRRRRLRHLGPDTMRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 11280 - protein, 431 aa, Human
HFFWAHEAAVPCSAEHGGAMPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 11281 - protein, 501 aa, Human
VIQLMKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 11282 - protein, 506 aa, Human
LPKMPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSLHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 11283 - protein, 174 aa, Human
AAGQAPPRPRPAAAMQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEKTETMYHSKSFIGFKKAY

SEQ ID NO: 11284 - protein, 819 aa, Human
GKSFSGCDLGSQGTMSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSIWLIVFGVVMGVIVVGIVILIFTGIRDRKKKNKARSGENPYASIDISKGENNPGFQNTDDVQTSF

SEQ ID NO: 11285 - protein, 694 aa, Human
KALSSSLTKQPLLQRMATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 11286 - protein, 362 aa, Human
SVDIEIFKMYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 11287 - protein, 475 aa, Human
PAEKKKPSVRDSDLSAAPSVRGASRGRAMLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 11288 - protein, 475 aa, Human; identical to SEQ ID NO: 11287

SEQ ID NO: 11289 - protein, 462 aa, Human
APTLGGTGRPTMPKNKKRNTPHRGSSAGGGGSGAAAATAATAGGQHRNVQPFSDEDASIETMSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTCATCFGVCCFIATDDITELYSTLECLENIFTKSYLKEKDTTVICSTPNTVLHISSLLAWTLLLTICPINEVKKKLEMHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 11290 - protein, 364 aa, Human
GPSSHGQGSAQDRKPVASSPPPVMQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 11291 - protein, 381 aa, Human
PRTQPPRWGRRDRVPGMSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 11292 - protein, 672 aa, Human
GVAATRVRRRLAITGLTMERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 11293 - protein, 124 aa, Human
CLPPPTPAVPLTMEKILILLLVALSVAYAAPGPRGIIINLENGELCMNSAQCKSNCCQHSSALGLARCTSMASENSECSVKTLYGIYYKCPCERGLTCEGDKTIVGSITNTNFGICHDAGRSKQ

SEQ ID NO: 11294 - protein, 479 aa, Human
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 11295 - protein, 146 aa, Human
FALTSVDQRPWTVSSKRQWKGEIQEFCPNTKMLLVGCKSDLRTDVSTLVELSNHRQTPVSYDQGANMAKQIGAATYIECSALQSENSVRDIFHVATLACVNKTNKNVKRNKSQRATKRISHMPSRPELSAVATDLRKDKAKSCTVM

SEQ ID NO: 11296 - protein, 648 aa, Human
RRADYACQGRAERIAGRCAEERRECPARCRRAEPVSAPDQSRTLDSRGPGTTELMASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMFTYEIAPVFVLMEQITLKKMREIVGWSSKDGDGIFSPGGAISNMYSIMAARYKYFPEVKTKGMAAVPKLVLFTSEQSHYSIKKAGAALGFGTDNVILIKCNERGKIIPADFEAKILEAKQKGYVPFYVNATAGTTVYGAFDPIQEIADICEKYNLWLHVDAAWGGGLLMSRKHRHKLNGIERANSVTWNPHKMMGVLLQCSAILVKEKGILQGCNQMCAGYLFQPDKQYDVSYDTGDKAIQCGRHVDIFKFWLMWKAKGTVGFENQINKCLELAEYLYAKIKNREEFEMVFNGEPEHTNVCFWYIPQSLRGVPDSPQRREKLHKVAPKIKALMMESGTTMVGYQPQGDKANFFRMVISNPAATQSDIDFLIEEIERLGQDL

SEQ ID NO: 11297 - protein, 225 aa, Human
LMASSTPSSSATSSNAGADPNTTNLRPTTYDTWCGVAHGCTRKLGLKICGFLQRTNSLEEKSRLVSAFKERQSSKNLLSCENSDRDARFRRTETDFSNLFARDLLPAKNGEEQTVQFLLEVVDILLNYVRKTFDRSTKVLDFHHPHQLLEGMEGFNLELSDHPESLEQILVDCRDTLKYGVRTGHPRFFNQLSTGLDIIGLAGEWLTSTANTNMPSDMRECWLLR

SEQ ID NO: 11298 - protein, 225 aa, Human; identical to SEQ ID NO: 11297

SEQ ID NO: 11299 - protein, 684 aa, Human
QILITEFQGEGTCEMGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 11300 - protein, 507 aa, Human
SIMNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRLKDANDVPIQCEISPLISYAGEGLESYVADKEFHAPLIIDENGVHELVKNGI

SEQ ID NO: 11301 - protein, 343 aa, Human
GAAMLEAPGPSDGCELSNPSASRVSCAGQMLEVQPGLYFGGAAAVAEPDHLREAGITAVLTVDSEEPSFKAGPGVEDLWRLFVPALDKPETDLLSHLDRCVAFIGQARAEGRAVLVHCHAGVSRSVAIITAFLMKTDQLPFEKAYEKLQILKPEAKMNEGFEWQLKLYQAMGYEVDTSSAIYKQYRLQKVTEKYPELQNLPQELFAVDPTTVSQGLKDEVLYKCRKCRRSLFRSSSILDHREGSGPIAFAHKRMTPSSMLTTGRQAQCTSYFIEPVQWMESALLGVMDGQLLCPKCSAKLGSFNWYGEQCSCGRWITPAFQIHKNRVDEMKILPVLGSQTGKI

SEQ ID NO: 11302 - protein, 297 aa, Human
PTETGHWTGSAMRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQINKASPRRLPRKRAQKRSVGSDE

SEQ ID NO: 11303 - protein, 308 aa, Human
AEKRASKMATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKTDWLDGKHVVFGEVTEGLDVLRQIEAQGSKDGKPKQKVIIADCGEYV

SEQ ID NO: 11304 - protein, 1016 aa, Human
SLERRRPLPKLERGMPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSVGIGNLQRTSSQRSTLTYQRNNYALNTTATYAEPYRPIQYRVQECNYNRLQHAVPADDGTTRSPSIDSIQKDPRRFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRQIISESGEGSSPGLEYIMAISGPPEHL

SEQ ID NO: 11305 - protein, 138 aa, Human
MAKQPSDVSSECDREGRQLQPAERPPQLRPGAPTSLQTEPQDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 11306 - protein, 496 aa, Human [sequence omitted]

SEQ ID NO: 11307 - protein, 455 aa, Human
TLDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 11308 - protein, 612 aa, Human
QAPPLVQLEQPFQGAPPSQKAVQIQLPPQQAQASGPQAEVPTLPLQPSWQAPPAVLQAQPGPPVAAANFPLGSAKSLMTPSGECRASSIDRRGSSKERRTSSKERRAPSKDRMIFAATFCAPKAVSAARAHLPAAWKNLPATPETFAPSSSVFPATSQFQPASLNAFKGPSAASETPKSLPYALQDPFACVEALPAVPWVPQPNMNASKASQAVPTFLMATAAAPQATATTQEASKTSVEPPRRSGKATRKKKHLEAQEDSRGHTLAFHDWQGPRPWENLNLSDWEVQSPIQVSGDWEHPNTPRGLSGWEGPSTSRILSGWEGPSASWALSAWEGPSTSRALGLSESPGSSLPVVVSEVASVSPGSSATQDNSKVEAQPLSPLDERANALVQFLLVKDQAKVPVQRSEMVKVILREYKDECLDIINRANNKLECAFGYQLKEIDTKNHAYIIINKLGYHTGNLVASYLDRPKFGLLMVVLSLIFMKGNCVREDLIFNFLFKLGLDVRETNGLFGNTKKLITEVFVRQKYLEYRRIPYTEPAEYEFLWGPRAFLETSKMLVLRFLAKLHKKDPQSWPFHYLEALAECEWEDTDEDEPDTGDSAHGPTSRPPPR

SEQ ID NO: 11309 - protein, 272 aa, Human
ENLRHTFIYSLPLGLQKHQVLTVDIGFGGTAIMTVGKSSKMLQHIDYRMRCILQDGRIFIGTFKAFDKHMNLILCDCDEFRKIKPKNAKQPEREEKRVLGLVLLRGENLVSMTVEGPPPKDTGIARVPLAGAAGGPGVGRAAGRGVPAGVPIPQAPAGLAGPVRGVGGPSQQVMTPQGRGTVAAAAVAATASIAGAPTQYPPGRGTPPPPVGRATPPPGIMAPPPGMRPPMGPPIGLPPARGTPIGMPPPGMRPPPPGIRGPPPPGMRPPRP

SEQ ID NO: 11310 - protein, 179 aa, Human
CAQPAMGKITLYEDRGFQGRHYECSSDHPNLQPYLSRCNSARVDSGCWMLYEQPNYSGLQYFLRRGDYADHQQWMGLSDSVRSCRLIPHSGSHRIRLYEREDYRGQMIEFTEDCSCLQDRFRFNEIHSLNVLEGSWVLYELSNYRGRQYLLMPGDYRRYQDWGATNARVGSLRRVIDFS

SEQ ID NO: 11311 - protein, 1501 aa, Human
VFGIRSLSPDGPSRDPSARETMQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 11312 - protein, 341 aa, Human
PLTVSERWPLARATPFCFGSAMPMYQVKPYHGGGAPLRVELPTCMYRLPNVHGRSYGPAPGAGHVQEESNLSLQALESRQDDILKRLYELKAAVDGLSKMIQTPDADLDVTNIIQADEPTTLTTNALDLNSVLGKDYGALKDIVINANPASPPLSLLVLHRLLCEHFRVLSTVHTHSSVKSVPENLLKCFGEQNKKQPRQDYQLGFTLIWKNVPKTQMKFSIQTMCPIEGEGNIARFLFSLFGQKHNAVNATLIDSWVDIAIFQLKEGSSKEKAAVFRSMNSALGKSPWLAGNELTVADVVLWSVLQQIGGCSVTVPANVQRWMRSCENLAPFNTALKLLK

SEQ ID NO: 11313 - protein, 404 aa, Human
TTAETASAPRAQSLAFADPPPVHTRRQLTMDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 11314 - protein, 202 aa, Human
HKQNLQNRFSFPSHQLLELELSAMAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 11315 - protein, 201 aa, Human
RSAIRRERSVKSFGPDQLDTRTTDFNFFGLILSETMKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 11316 - protein, 472 aa, Human
LIPHQLRHPRGLPPGALSRPPKKRRSPLLAHPFPSSLPPPPELSLSHAFPLHHGSPLGCRLPGSCVRSERRRWRRWRRRRQLGSAMTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDELTRHLRIHTGHKPFQCRICMRSFSRSDHLTTHIRTHTGEKPFACEFCGRKFARSDERKRHAKIHLKQKEKKAEKGGAPSASSAPPVSLAPVVTTCA

SEQ ID NO: 11317 - protein, 238 aa, Human
VGCRANFPASMQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWVRKT

SEQ ID NO: 11318 - protein, 494 aa, Human
YQRQLKEMNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 11319 - protein, 591 aa, Human
ELEHQQALEASLLPLPLISQRMTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMASRGNINVILVQYKAVKETKVKELKRAKTVLTVIKWKGEKSKYPQGRFWKQLQVAMPVKKSPRRSSSDEQGLSYSSLKNV

SEQ ID NO: 11320 - protein, 615 aa, Human
GDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEDVSQAFLEAVAEEKPHVKPYFSKTIRDLEVVEGSAARFDCKIE

SEQ ID NO: 11321 - protein, 1070 aa, Human
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 11322 - protein, 224 aa, Human [sequence omitted]

SEQ ID NO: 11323 - protein, 328 aa, Human [sequence omitted]

SEQ ID NO: 11324 - protein, 850 aa, Human
MAAAAPAAAAASSEAPAASATAEPEAGDQDSREVRVLQSLRGKICEAKNLLPYLGPHKMRDCFCTINLDQEEVYRTQVVEKSLSPFFSEEFYFEIPRTFQYLSFYVYDKNVLQRDLRIGKVAIKKEDLCNHSGKETWFSLQPVDSNSEVQGKVHLELKLNELITENGTVCQQLVVHIKACHGLPLINGQSCDPYATVSLVGPSRNDQKKTKVKKKTSNPQFNEIFYFEVTRSSSYTRKSQFQVEEEDIEKLEIRIDLWNNGNLVQDVFLGEIKVPVNVLRTDSSHQAWYLLQPRDNGNKSSKTDDLGSLRLNICYTEDYVLPSEYYGPLKTLLLKSPDVQPISASAAYILSEICRDKNDAVLPLVRLLLHHDKLVPFATAVAELDLKDTQDANTIFRGNSLATRCLDEMMKIVGGHYLKVTLKPILDEICDSSKSCEIDPIKLKEGDNVENNKENLRYYVDKLFNTIVKSSMSCPTVMCDIFYSLRQMATQRFPNDPHVQYSAVSSFVFLRFFAVAVVSPHTFHLRPHHPDAQTIRTLTLISKTIQTLGSWGSLSKSKSSFKETFMCEFFKMFQEEGYIIAVKKFLDEISSTETKESSGTSEPVHLKEGEMYKRAQGRTRIGKKNFKKRWFCLTSRELTYHKQPGSKDAIYTIPVKNILAVEKLEESSFNKKNMFQVIHTEKPLYVQANNCVEANEWIDVLCRVSRCNQNRLSFYHPSVYLNGNWLCCQETGENTLGCKPCTAGVPADIQIDIDEDRETERIYSLFTLSLLKLQKMEEACGTIAVYQGPQKEPDDYSNFVIEDSVTTFKTIQQIKSIIEKLDEPHEKYRKKRSSSAKYGSKENPIVGKAS

SEQ ID NO: 11325 - protein, 574 aa, Human
RRFPSGPKGGNASAPARTMARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 11326 - protein, 703 aa, Human
FADKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 11327 - protein, 245 aa, Human [sequence omitted]

SEQ ID NO: 11328 - protein, 556 aa, Human
SLALAAGRLCGSASRLLRIGSAQLGEKMFTVLTRQPCEQAGLKALYRTPTIIALVVLLVSIVVLVSITVIQIHKQEVLPPGLKYGIVLDAGSSRTTVYVYQWPAEKENNTGVVSQTFKCSVKGSGISSYGNNPQDVPRAFEECMQKVKGQVPSHLHGSTPIHLGATAGMRLLRLQNETAANEVLESIQSYFKSQPFDFRGAQIISGQEEGVYGWITANYLMGNFLEKNLWHMWVHPHGVETTGALDLGGASTQISFVAGEKMDLNTSDIMQVSLYGYVYTLYTHSFQCYGRNEAEKKFLAMLLQNSPTKNHLTNPCYPRDYSISFTMGHVFDSLCTVDQRPESYNPNDVITFEGTGDPSLCKEKVASIFDFKACHDQETCSFDGVYQPKIKGPFVAFAGFYYTASALNLSGSFSLDTFNSSTWNFCSQNWSQLPLLLPKFDEVYARSYCFSANYIYHLFVNGYKFTEETWPQIHFEKEVGNSSIAWSLGYMLSLTNQIPAESPLIRLPIEPPVFVGTLAFFTAAALLCLAFLAYLCSATRRKRHSEHAFDHAVDSD

SEQ ID NO: 11329 - protein, 569 aa, Human
GRYLHPCFCLVDPLSFRDSGTPVVFSSSNDPEGMEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 11330 - protein, 420 aa, Human
RMPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 11331 - protein, 1716 aa, Human
HTLVMDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTGYKRSSLSKSKISCFWG

SEQ ID NO: 11332 - protein, 956 aa, Human
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 11333 - protein, 317 aa, Human
MAAPMELFCWSGGWGLPSVDLDSLAVLTYARFTGAPLKVHKISNPWQSPSGTLPALRTSHGEVISVPHKIITHLRKEKYNADYDLSARQGADTLAFMSLLEEKLLPVLVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 11334 - protein, 587 aa, Human
HSMVPQPQAHTESMSIQENISSLQLRSWVSKSQRDLAKSILIGAPGGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 11335 - protein, 311 aa, Human
AAMDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 11336 - protein, 326 aa, Human
REAGRGCSAGVGGRPRRRRRKGAASRARLPFSLSIMDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKKKILFFNDKSCQFSVDEEFQKLWRSVTVDSMDEEKIEEYLKRQGISSMQESGPKKVAPIQRRKKPASQKKRRFKTHNEHLAGVLKDYSDITSSK

SEQ ID NO: 11337 - protein, 274 aa, Human
ASATMASRGVVGIFFLSAVPLVCLELRRGIPDIGIKDFLLLCGRILLLLALLTLIISVTTSWLNSFKSPQVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 11338 - protein, 275 aa, Human
ARPTWRATSACMALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGVIVGAGYIAVEMAGILSALGSKTSLMIRHDKV

SEQ ID NO: 11339 - protein, 304 aa, Human
ERRAVTMGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 11340 - protein, 192 aa, Human
EFLSALGKPVYAPKMSKTGTKITFYEDKNFQGRRYDCDCDCADFHTYLSRCNSIKVEGGTWAVYERPNFAGYMYILPQGEYPEYQRWMGLNDRLSSCRAVHLPSGGQYKIQIFEKGDFSGQMYETTEDCPSIMEQFHMREIHSCKVLEGVWIFYELPNYRGRQYLLDKKEYRKPIDWGAASPAVQSFRRIVE

SEQ ID NO: 11341 - protein, 314 aa, Human
TTPRNTDGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 11342 - protein, 808 aa, Human
SRSPVLDPSEPQPLAAMHVIKRDGRQERVMFDKITSRIQKLCYGLNMDFVDPAQITMKVIQGLYSGVTTVELDTLAAETAATLTTKHPDYAILAARIAVSNLHKETKKVFSDVMEDLYNYINPHNGKHSPMVAKSTLDIVLANKDRLNSAIIYDRDFSYNYFGFKTLERSYLLKINGKVAERPQHMLMRVSVGIHKEDIDAAIETYNLLSERWFTHASPTLFNAGTNRPQLSSCFLLSMKDDSIEGIYDTLKQCALISKSAGGIGVAVSCIRATGSYIAGTNGNSNGLVPMLRVYNNTARYVDQGGNKRPGAFAIYLEPWHLDIFEFLDLKKNTGKEEQRARDLFFALWIPDLFMKRVETNQDWSLMCPNECPGLDEVWGEEFEKLYASYEKQGRVRKVVKAQQLWYAIIESQTETGTPYMLYKDSCNRKSNQQNLGTIKCSNLCTEIVEYTSKDEVAVCNLASLALNMYVTSEHTYDFKKLAEVTKVVVRNLNKIIDINYYPVPEACLSNKRHRPIGIGVQGLADAFILMRYPFESAEAQLLNKQIFETIYYGALEASCDLAKEQGPYETYEGSPVSKGILQYDMWNVTPTDLWDWKVLKEKIAKYGIRNSLLIAPMPTASTAQILGNNESIEPYTSNIYTRRVLSGEFQIVNPHLLKDLTERGLWHEEMKNQIIACNGSIQSIPEIPDDLKQLYKTVWEISQKTVLKMAAERGAFIDQSQSLNIHIAEPNYGKLTSMHFYGWKQGLKTGMYYLRTRPAANPIQFTLNKEKLKDKEKVSKEEEEKERNTAAMVCSLENRDECLMCGS

SEQ ID NO: 11343 - protein, 234 aa, Human
LLEPGAAAAAPSSPASGRAPGHCSQRGPEERGGTASTTATAPTMQSIKCVVVGDGAVGKTCLLICYTTNAFPKEYIPTVFDNYSAQSAVDGRTVNLNLWDTAGQEEYDRLRTLSYPQTNVFVICFSIASPPSYENVRHKWHPEVCHHCPDVPILLVGTKKDLRAQPDTLRRLKEQGQAPITPQQGQALAKQIHAVRYLECSALQQDGVKEVFAEAVRAVLNPTPIKRGRSCILL

SEQ ID NO: 11344 - protein, 367 aa, Human
ACQARQRGVRRSSPSPFKLYPSTDLFHCLPSEIEVECCLGILSQSSSSRSDKMYQVPLPLDRDGTLVRLRFTMVALVTVCCPLVAFLFCILWSLLFHFKETTATHCGATPCRMFSAASQPLDPDGTLFRLRFTAMVWWAITFPVFGFFFCIIWSLVFHFEYTVATDCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 11345 - protein, 1709 aa, Human
HFPFPTEPRFLKQRLILKMFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQ

SEQ ID NO: 11346 - protein, 340 aa, Human
DPKRDSNWPRVTSMQMPAMMSLLLVSVGLMEALQAQSHPITRRDLFSQEIQLDMALASFDDQYAGCAAAMTAALPDLNHTEFQANQVYADSWTLASSQWQERQARWPEWSLSPTRPSPPPLGFRDEHGVALLAYTANSPLHKEFNAAVREAGRSRAHYLHHFSFKTLHFLLTEALQLLGSGQRPPRCHQVFRGVHGLRFRPAGPRATVRLGGFASASLKHVAAQQFGEDTFFGIWTCLGAPIKGYSFFPGEEEVLIPPFETFQVINASRLAQGPARIYLRALGKHSTYNCEYIKDKKCKSGPCHLDNSAMGQSPLSAVWSLLLLLWFLVVRAFPDGPGLL

SEQ ID NO: 11347 - protein, 605 aa, Human
VNHSRGTEVSEPSPPVRDPEGVTQAPGVEPSNGLEKPARELNGSEAATPRDSPRPGKPDERDIWPPAQAPTSSQELAGAPEPQGSCAQGGRVAPGQRPAQGATGTDLDFDLSSDSESSSESEGTKSSSSASDGESEGKRGRQKPKAAPEGAGALAQGSSLEPGRPAAPSLPGEAEPGAHAPDKEPELGGQEEGERDGLCGLGNGCADRKEAETESQNSELSGVTAGESLDQSMEEEEEEDTDEDDHLIYLEEILVRVHTDYYAKYDRYLNKEIEEAPDIRKIVPELKSKVLADVAIIFSGLHPTNFPIEKTREHYHATALGAKILTRLVLSPDAPDRATHLIAARAGTEKVLQAQECGHLHVVNPDWLWSCLERWDKVEEQLFPLRDDHTKAQRENSPAAFPDREGVPPTALFHPMPVLPKAQPGPEVRIYDSNTGKLIRTGARGPPAPSSSLPIRQEPSSFRAVPPPQPQMFGEELPDAQDGEQPGPSRRKRQPSMSETMPLYTLCKEDLESMDKEVDDILGEGSDDSDSEKRRPEEQEEEPQPRKPGTRRERTLGAPAGHKRKLNEEDAASESSRESSNEDEGSSSEADEMAKALEAELNDLM

SEQ ID NO: 11348 - protein, 407 aa, Human
REPGGAANMAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 11349 - protein, 283 aa, Human
VKMSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 11350 - protein, 247 aa, Human
PGDRRHEGPPAEMTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 11351 - protein, 467 aa, Human
LVSIMATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 11352 - protein, 443 aa, Human
SVRLPADALELGRPGALVGRLPPEGGVSGAWPERLSSEPRPGRAQLRAARIMAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 11353 - protein, 399 aa, Human
PGVPGAAGCGLPLRRVRSGHEKRTVDLPPASSSAMWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 11354 - protein, 567 aa, Human
PAAGAATMEFRQEEFRKLAGRALGKLHRLLEKRQEGAETLELSADGRPVTTQTRDPPVVDCTCFGLPRRYIIAIMSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 11355 - protein, 766 aa, Human
KGLSFGGGCSGSSSGSCPRSPAFTFPHPINPVAYQQILSQQRGLGSAFGHTPPLIQPSPTFLAQQPMALTSINATPTQLSSSSNCLSDTNQNKQSSESAVSSTVNPVAIHKRSKVKTEPEGLRPASPLALTQGQVSGHGSCGCALPLSQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGRRPPATTRAPLTPTTPSPRTRRGARARPASAAAAPGCSTSRRRTSTACVPSTRQHWRAPRHSAAGPGAHETANQAGAAGRARATLPAGCPRPLGRGVAATGRPMATATRGLRALPPRGSRRRSQAGQRPCAAARCPVPAAGAALPQHPQREPRPAAALCRQARPPPAEPPEHRRRPGPRRLLAPAA

SEQ ID NO: 11356 - protein, 766 aa, Human; identical to SEQ ID NO: 11355

SEQ ID NO: 11357 - protein, 766 aa, Human; identical to SEQ ID NO: 11355

SEQ ID NO: 11358 - protein, 766 aa, Human; identical to SEQ ID NO: 11355

SEQ ID NO: 11359 - protein, 352 aa, Human
EGTMPVERMRMRPWLEEQINSNTIPGLKWLNKEKKIFQIPWMHAARHGWDVEKDAPLFRNWAIHTGKHQPGVDKPDPKTWKANFRCAMNSLPDIEEVKDKSIKKGNNAFRVYRMLPLSERPSKKGKKPKTEKEDKVKHIKQEPVESSLGLSNGVSDLSPEYAVLTSTIKNEVDSTVNIIVVGQSHLDSNIENQEIVTNPPDICQVVEVTTESDEQPVSMSELYPLQISPVSSYAESETTDSVPSDEESAEGRPHWRKRNIEGKQYLSNMGTRGSYLLPGMASFVTSNKPDLQVTIKEESNPVPYNSSWPPFQDLPLSSSMTPASSSSRPDRETRASVIKKTSDITQARVKSC

SEQ ID NO: 11360 - protein, 770 aa, Human
AILDDPMECSRGERLSITLAKNRINRAPERLGKAKVEVDIFELLRDSEYETAETMCQILPKGVVAVLGPSSSPASSSIISNICGEKEVPHFKVAPEEFVKFQFQRFTTLNLHPSNTDISVAVAGILNFFNCTTACLICAKAECTQVSCSSSDMATAAELGMVSAYYTYIFTNLELNRSQEIGVKPLSCGSAQIWQHGTSLMNYLRMVELEGLTGHIEFNSKGQRSNYALKILQFTRNGFRQIGQWHVAEGLSMDSHLYASNISDTLFNTTLVVTTILENPYLMLKGNHQEMEGNDRYEGFCVDMLKELAEILRFNYKIRLVGDGVYGVPEANGTWTGMVGELIARKADLAVAGLTITAEREKVIDFSKPFMTLGISILYRVHMGRKPGYFSFLDPFSPGVWLFMLLAYLAVSCVLFLVARLTPYEWYSPHPCAQGRCNLLVNQYSLGNSLWFPVGGFMQQGSTIAPRALSTRCVSGVWWAFTLIIISSYTANLAAFLTVQRMDVPIESVDDLADQTAIEYGTIHGGSSMTFFQNSRYQTYQRMWNYMYSKQPSVFVKSTEEGIARVLNSNYAFLLESTMNEYYRQRNCNLTQIGGLLDTKGYGIGMPVGSVFRDEFDLAILQLQENNRLEILKRKWWEGGKCPKEEDHRAKGLGMENIGGIFVVLICGLIVAIFMAMLEFLWTLRHSEATEERRPRGTATLSNGKLCGAGEPDQLAQRLAQEAALVARGCTHIRVCPECRRFQGLRARPSPARSEESLEWEKTTNSSEPE

SEQ ID NO: 11361 - protein, 625 aa, Human
CGSNMAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 11362 - protein, 298 aa, Human
TKPLRGTRHNRLLWDSLQPIFIAQVSEAAMAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 11363 - protein, 854 aa, Human
MQRRGALFGMPGGSGGRKMAAGDIGELLVPHMPTIRVPRSGDRVYKNECAFSYDSPNSEGGLYVCMNTFLAFGREHVERHFRKTGQSVYMHLKRHVREKVRGASGGALPKRRNSKIFLDLDTDDDLNSDDYEYEDEAKLVIFPDHYEIALPNIEELPALVTIACDAVLSSKSPYRKQDPDTWENELPVSKYANNLTQLDNGVRIPPSGWKCARCDLRENLWLNLTDGSVLCGKWFFDSSGGNGHALEHYRDMGYPLAVKLGTITPDGADVYSFQEEEPVLDPHLAKHLAHFGIDMLHMHGTENGLQDNDIKLRVSEWEVIQESGTKLKPMYGPGYTGLKNLGNSCYLSSVMQAIFSIPEFQRAYVGNLPRIFDYSPLDPTQDFNTQMTKLGHGLLSGQYSKPPVKSELIEQVMKEEHKPQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELTRREAEANRRPLPELVRAKIPFSACLQAFSEPENVDDFWSSALQAKSAGVKTSRFASFPEYLVVQIKKFTFGLDWVPKKFDVSIDMPDLLDINHLRARGLQPGEEELPDISPPIVIPDDSKASDIDESSVMQLAEMGFPLEACRKAVYFTGNMGAEVAFNWIIVHMEEPDFAEPLTMPGYGGAASAGASVFGASGLDNQPPEEIVAIITSMGFQRNQAIQALRATNNNLERALDWIFSHPEFEEDSDFVIEMENNANANIISEAKPEGPRVKDGSGTYELFAFISHMGTSTMSGHYICHIKKEGRWVIYNDHKVCASERPPKDLGYMYFYRRIPS

SEQ ID NO: 11364 - protein, 291 aa, Human
CSADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSLCIYIDGNILYILYHRAYSRCHRV

SEQ ID NO: 11365 - protein, 657 aa, Human
VDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATRCERLPCHENRECSKLPLRITYYHLSFPTNIQAPAVVFRMGPSSAVPGDSMQLAITGGNEEGFFTTRKVSPHSGVVALTKPVPEPRDLLLTVKMDLSRHGTVSSFVAKLFIFVSAEL

SEQ ID NO: 11366 - protein, 657 aa, Human; identical to SEQ ID NO: 11365

SEQ ID NO: 11367 - protein, 657 aa, Human; identical to SEQ ID NO: 11365

SEQ ID NO: 11368 - protein, 657 aa, Human; identical to SEQ ID NO: 11365

SEQ ID NO: 11369 - protein, 677 aa, Human
VDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFRACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATLQQEKTDTVRCIKSCRPNDVTCVFDPVHTISHTVISLPTFREFTRPEEIIFLRAITPPHPASQANIIFDITEGNLRDSFDIIKRYMDGMTVGVVRQVRPIVGPFHAVLKLEMNYVVGGVVSHRNVVNVHIFVSEYWF

SEQ ID NO: 11370 - protein, 677 aa, Human; identical to SEQ ID NO: 11369

SEQ ID NO: 11371 - protein, 677 aa, Human; identical to SEQ ID NO: 11369

SEQ ID NO: 11372 - protein, 677 aa, Human; identical to SEQ ID NO: 11369

SEQ ID NO: 11373 - protein, 243 aa, Human
MAAAIASSLIRQKRQARESNSDRVSASKRRSSPSKDGRSLCERHVLGVFSKVRFCSGRKRPVRRRPEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 11374 - protein, 550 aa, Human
PTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 11375 - protein, 327 aa, Human
RAAPSVLASLTHPHRPLFLLPLGAAAAMILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKKDRVTVVFSTVFKDDDDVVIGKVFMQEFKEGRRASHTAPQVLFSHREPPLELKDTDAAVGDNIGYITFVLFPRHTNASARDNTINLIHTFRDYLHYHIKCSKAYIHTRMRAKTSDFLKVLNRARPDAEKKEMKTITGKTFSSR

SEQ ID NO: 11376 - protein, 204 aa, Human
SRMATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 11377 - protein, 303 aa, Human
GSLASPPSLGSMGEKSENCGVPEDLLNGLKVTDTQEAECAGPPVPDPKNQHSQSKLLRDDEAHLQEDQGEEECFHDCSASFEEEPGADKVENKSNEDVNSSELDEEYLIELEKNMSDEEKQKRREESTRLKEEGNEQFKKGDYIEAESSYSRALEMCPSCFQKERSILFSNRAAARMKQDKKEMAINDCSKAIQLNPSYIRAILRRAELYEKTDKLDEALEDYKSILEKDPSIHQAREACMRLPKQIEERNERLKEEMLGKLKDLGNLVLRPFGLSTENFQIKQDSSTGSYSINFVQNPNNNR

SEQ ID NO: 11378 - protein, 386 aa, Human
RPARSGCPARGHSEPGGREEGGMPQTVILPGPAPWGFRLSGGIDFNQPLVITRITPGSKAAAANLCPGDVILAIDGFGTESMTHADAQDRIKAAAHQLCLKIDRGETHLWSPQVSEDGKAHPFKINLESEPQDGNYFEHKHNIRPKPFVIPGRSSGCSTPSGIDCGSGRSTPSSVSTVSTICPGDLKVAAKLAPNIPLEMELPGVKIVHAQFNTPMQLYSDDNIMETLQGQVSTALGETPLMSEPTASVPPESDVYRMLHDNRNEPTQPRQSGSFRVLQGMVDDGSDDRPAGTRSVRAPVTKVHGGSGGAQRMPLCDKCGSGIVGAVVKARDKYRHPECFVCADCNLNLKQKGYFFIEGELYCETHARARTKPPEGYDTVTLYPKA

SEQ ID NO: 11379 - protein, 422 aa, Human
NIVMLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPALENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 11380 - protein, 514 aa, Human
MGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 11381 - protein, 322 aa, Human
RRSHTWVPAPQRSRDSPRRRARRPELPKPSRAAHTPGLHSLFQHPLVLAAARVPETELPQRPRRRRCEGPMRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 11382 - protein, 1540 aa, Human
EDNPEIAAAIEEERASARSKRSSPKSRKGKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEEDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRNFL

SEQ ID NO: 11383 - protein, 1540 aa, Human; identical to SEQ ID NO: 11382

SEQ ID NO: 11384 - protein, 274 aa, Human
EKMVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 11385 - protein, 376 aa, Human
TRLQVKMSHPSPQAKPSNPSNPRVFFDVDIGGERVGRIVLELFADIVPKTAENFRALCTGEKGIGHTTGKPLHFKGCPFHRIIKKFMIQGGDFSNQNGTGGESIYGEKFEDENFHYKHDREGLLSMANAGRNTNGSQFFITTVPTPHLDGKHVVFGQVIKGIGVARILENVEVKGEKPAKLCVIAECGELKEGDDGGIFPKDGSGDSHPDFPEDADIDLKDVDKILLITEDLKNIGNTFFKSQNWEMAIKKYAEVLRYVDSSKAVIETADRAKLQPIALSCVLNIGACKLKMSNWQGAIDSCLEALELDPSNTKALYRRAQGWQGLKEYDQALADLKKAQGIAPEDKAIQAELLKVKQKIKAQKDKEKAVYAKMFA

SEQ ID NO: 11386 - protein, 563 aa, Human
TQVAEAGRGEGVVAGAETGRPQSAGMNLELLESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKGKEKDSPFKPKLYKGDRGLPLEGSAKGKVQAELSQPLTAGGAISELL

SEQ ID NO: 11387 - protein, 1650 aa, Human
RWQEVETLLPVSPILTMSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEVSSLPLVLASAPSWEWACLPDIYVLLKQWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 11388 - protein, 365 aa, Human
MTSFSTSAQCSTSDSACRISPGQINQVMHYLGQYIMVKQLYDQQEQHMVYCGGDLLGELLGRQSFSVKDPSKVQRKVPLPEKELQKTISPHCLPQSINAYILEKDVGTAIVSDTTDDLWFLNESVSEQLGVGIKVEAADTEQTSEEVGKVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 11389 - protein, 661 aa, Human
PRSLPRSAQQPRFSQNTGIFSGRRSNQKTEMNFNTILEEILIKRSQQKKKTSPLNYKERLFVLTKSMLTYYEGRAEKKYRKGFIDVSKIKCVEIVKNDDGVIPCQNKYPFQVVHDANTLYIFAPSPQSRDLWVKKLKEEIKNNNNIMIKYHPKFWTDGSYQCCRQTEKLAPGCEKYNLFESSIRKALPPAPETKKRRPPPPIPLEEEDNSEEIVVAMYDFQAAEGHDLRLERGQEYLILEKNDVHWWRARDKYGNEGYIPSNYVTGKKSNNLDQYEWYCRNMNRSKAEQLLRSEDKEGGFMVRDSSQPGLYTVSLYTKFGGEGSSGFRHYHIKETTTSPKKYYLAEKHAFGSIPEIIEYHKHNAAGLVTRLRYPVSVKGKNAPTTAGFSYEKWEINPSELTFMRELGSGLFGVVRLGKWRAQYKVAIKAIREGAMCEEDFIEEAKVMMKLTHPKLVQLYGVCTQQKPIYIVTEFMERGCLLNFLRQRQGHFSRDVLLSMCQDVCEGMEYLERNSFIHRDLAARNCLVSEAGVVKVSDFGMARYVLDDQYTSSSGAKFPVKWCPPEVFNYSRFSSKSDVWSFGVLMWEVFTEGRMPFEKYTNYEVVTMVTRGHRLYQPKLASNYVYEVMLRCWQEKPEGRPSFEDLLRTIDELVECEETFGR

SEQ ID NO: 11390 - protein, 313 aa, Human
GDKNIQMADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKGNIRGWRITG

SEQ ID NO: 11391 - protein, 638 aa, Human
NARLSGGQEMTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTALCSPGVLQTVKWFLEFRCIFSLAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 11392 - protein, 1165 aa, Human [sequence omitted]

SEQ ID NO: 11393 - protein, 753 aa, Human
PGFPAMADSSGQQGKGRRVQPQWSPPAGTQPCRLHLYNSLTRNKEVFIPQDGKKVTWYCCGPTVYDASHMGHARSYISFDILRRVLKDYFKFDVFYCMNITDIDDKIIKRARQNHLFEQYREKRPEAAQLLEDVQAALKPFSVKLNETTDPDKKQMLERIQHAVQLATEPLEKAVQSRLTGEEVNSCVEVLLEEAKDLLSDWLDSTLGCDVTDNSIFSKLPKFWEGDFHRDMEALNVLPPDVLTRVSEYVPEIVNFVQKIVDNGYGYVSNGSVYFDTAKFASSEKHSYGKLVPEAVGDQKALQEGEGDLSISADRLSEKRSPNDFALWKASKPGEPSWPCPWGKGRPGWHIECSAMAGTLLGASMDIHGGGFDLRFPHHDNELAQSEAYFENDCWVRYFLHTGHLTIAGCKMSKSLKNFITIKDALKKHSARQLRLAFLMHSWKDTLDYSSNTMESALQYEKFLNEFFLNVKDILRAPVDITGQFEKWGEEEAELNKNFYDKKTAIHKALCDNVDTRTVMEEMRALVSQCNLYMAARKAVRKRPNQALLENIALYLTHMLKIFGAVEEDSSLGFPVGGPGTSLSLEATVMPYLQVLSEFREGVRKIAREQKVPEILQLSDALRDNILPELGVRFEDHEGLPTVVKLVDRNTLLKEREEKRRVEEEKRKKKEEAARRKQEQEAAKLAKMKIPPSEMFLSETDKYSKFDENGLPTHDMEGKELSKGQAKKLKKLFEAQEKLYKEYLQMAQNGSFQ

SEQ ID NO: 11394 - protein, 706 aa, Human
HLAAASSPAPAEGALTMAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCDCPKCCRCSKCCEDLEEAQEGQDVPVKAPETFDNITISREAQGEVPASDSKTECTAL

SEQ ID NO: 11395 - protein, 654 aa, Human
TSLRWPSKVRRPTMPPPPPLLLLTVLVVAAARPGCEFERNPAATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 11396 - protein, 445 aa, Human
TATASSPPQTPSQGARWRPRALARVPARRLRKPGMNAETCVSYCESPAAAMDAYYSPVSQSREGSSPFRAFPGGDKFGTTFLSAAAKAQGFGDAKSRARYGAGQQDLATPLESGAGARGSFNKFQPQPSTPQPQPSPQPQPQQQQPQPQPPAQPHLYLQRGACKTPPDGSLKLQEGSSGHSAALQVPCYAKESSLGEPELPPDSDTVGMDSSYLSVKEAGVKGPQDRASSDLPSPLEKADSESNKGKKRRNRTTFTSYQLEELEKVFQKTHYPDVYAREQLAMRTDLTEARVQVWFQNRRAKWRKRERFGQMQQVRTHFSTAYELPLLTRAENYAQIQNPSWLGNNGAASPVPACVVPCDPVPACMSPHAHPPGSGASSVTDFLSVSGAGSHVGQTHMGSLFGAASLSPGLNGYELNGEPDRKTSSIAALRMKAKEHSAAISWAT

SEQ ID NO: 11397 - protein, 693 aa, Human
IWLQGNNETCSWSWKLIRMFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLEVLSVLVPQS

SEQ ID NO: 11398 - protein, 261 aa, Human
GMATPPKRSCPSFSASSEGTRIKKISIEGNIAAGKSTFVNILKQLCEDWEVVPEPVARWCNVQSTQDEFEELTMSQKNGGNVLQMMYEKPERWSFTFQTYACLSRIRAQLASLNGKLKDAEKPVLFFERSVYSDRYIFASNLYESECMNETEWTIYQDWHDWMNNQFGQSLELDGIIYLQATPETCLHRIYLRGRNEEQGIPLEYLEKLHYKHESWLLHRTLKTNFDYLQEVPILTLDVNEDFKDKYESLVEKVKEFLSTL

SEQ ID NO: 11399 - protein, 285 aa, Human
DYPSSPHGLEMFPLLYELTAVSPSPFPQRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 11400 - protein, 688 aa, Human
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIREGSCSPRV

SEQ ID NO: 11401 - protein, 1211 aa, Human [sequence omitted]

SEQ ID NO: 11402 - protein, 443 aa, Human
GGGGEKMADDPSAADRNVEIWKIKKLIKSLEAARGNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 11403 - protein, 175 aa, Human
LLETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 11404 - protein, 287 aa, Human
PPLLPPRRRPICCPPRPLGHGARCPALAMATATGVAEERLLAALAYLQCAVGCAVFARNRQTNSVYGRHALPSHRLRVPARAAWVVQELPSLALPLYQYASESAPRLRSAPNCILLAMFLVHYGHRCLIYPFLMRGGKPMPLLACTMAIMFCTCNGYLQSRYLSHCAVYADDWVTDPRFLIGFGLWLTGMLINIHSDHILRNLRKPGDTGYKIPRGGLFEYVTAANYFGEIMEWCGYALASWSVQGAAFAFFTFCFLSGRAKEHHEWYLRKFEEYPKFRKIIIPFLF

SEQ ID NO: 11405 - protein, 244 aa, Human
LQEEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERGTIPGSGITESKDMHFSSLGCILLDVL

SEQ ID NO: 11406 - protein, 584 aa, Human
YLKRLATMSKPELKEDKMLEVHFVGDDDVLNHILDREGGAKLKKERAQLLVNPKKIIKKPEYDLEEDDQEVLKDQNYVEIMGRDVQESLKNGSATGGGNKVYSFQNRKHSEKMAKLASELAKTPQKSVSFSLKNDPEITINVPQSSKGHSASDKVQPKNNDKSEFLSTAPRSLRKRLIVPRSHSDSESEYSASNSEDDEGVAQEHEEDTNAVIFSQKIQAQNRVVSAPVGKETPSKRMKRDKTSDLVEEYFEAHSSSKVLTSDRTLQKLKRAKLDQQTLRNLLSKVSPSFSAELKQLNQQYEKLFHKWMLQLHLGFNIVLYGLGSKRDLLERFRTTMLQDSIHVVINGFFPGISVKSVLNSITEEVLDHMGTFRSILDQLDWIVNKFKEDSSLELFLLIHNLDSQMLRGEKSQQIIGQLSSLHNIYLIASIDHLNAPLMWDHAKQSLFNWLWYETTTYSPYTEETSYENSLLVKQSGSLPLSSLTHVLRSLTPNARGIFRLLIKYQLDNQDNPSYIGLSFQDFYQQCREAFLVNSDLTLRAQLTEFRDHKLIRTKKGTDGVEYLLIPVDNGTLTDFLEKEEEEA

SEQ ID NO: 11407 - protein, 782 aa, Human
MKIWGNKPCQARSLLFGLSRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQVVSRELRMPMSNVHLRGTSTETVPNANISGGSVVADLNGLAVKDACQTLLKRLEPIISKNPKGTWKDWAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 11408 - protein, 369 aa, Human
VPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 11409 - protein, 211 aa, Human
GPIHCAGASLGTGPKLTACTGACGAWVGRTGPWRALDLKPLFLRREEAGEEPTSPVTQYLQPRSPEECKMFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLIIGYARNPSLKQQLFSYAILGFALSEAMGLFCLMVAFLILFAM

SEQ ID NO: 11410 - protein, 796 aa, Human
TAMAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 11411 - protein, 245 aa, Human
WRSPSPLSASLHSTSPHPHALWTTTAGRAMAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 11412 - protein, 788 aa, Human
TMAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENLPGRNYTFWQWFDGVMEVLKKHLKPHWNDGAILGFVNKQQAHDLLINKPDGTFLLRFSDSEIGGITIAWKFDSQERMFWNLMPFTTRDFSIRSLADRLGDLNYLIYVFPDRPKDEVYSKYYTPVPCESATAKAVDGYVKPQIKQVVPEFVNASADAGGGSATYMDQAPSPAVCPQAHYNMYPQNPDSVLDTDGDFDLEDTMDVARRVEELLGRPMDSQWIPHAQS

SEQ ID NO: 11413 - protein, 845 aa, Human
PLSAAGEAMAEPSQAPTPAPAAQPRPLQSPAPAPTPTPAPSPASAPIPTPTPAPAPAPAAAPAGSTGTGGPGVGSGGAGSGGDPARPGLSQQQRASQRKAQVRGLPRAKKLEKLGVFSACKANETCKCNGWKNPKPPTAPRMDLQQPAANLSELCRSCEHPLADHVSHLENVSEDEINRLLGMVVDVENLFMSVHKEEDTDTKQVYFYLFKLLRKCILQMTRPVVEGSLGSPPFEKPNIEQGVLNFVQYKFSHLAPRERQTMFELSKMFLLCLNYWKLETPAQFRQRSQAEDVATYKVNYTRWLCYCHVPQSCDSLPRYETTHVFGRSLLRSIFTVTRRQLLEKFRVEKDKLVPEKRTLILTHFPKFLSMLEEEIYGANSPIWESGFTMPPSEGTQLVPRPASVSAAVVPSTPIFSPSMGGGSNSSLSLDSAGAEPMPGEKRTLPENLTLEDAKRLRVMGDIPMELVNEVMLTITDPAAMLGPETSLLSANAARDETARLEERRGIIEFHVIGNSLTPKANRRVLLWLVGLQNVFSHQLPRMPKEYIARLVFDPKHKTLALIKDGRVIGGICFRMFPTQGFTEIVFCAVTSNEQVKGYGTHLMNHLKEYHIKHNILYFLTYADEYAIGYFKKQGFSKDIKVPKSRYLGYIKDYEGATLMECELNPRIPYTELSHIIKKQKEIIKKLIERKQAQIRKVYPGLSCFKEGVRQIPVESVPGIRETGWKPLGKEKGKELKDPDQLYTTLKNLLAQIKSHPSAWPFMEPVKKSEAPDYYEVIRFPIDLKTMTERLRSRYYVTRKLFVADLQRVIANCREYNPPDSEYCRCASALEKFFYFKLKEGGLIDK

SEQ ID NO: 11414 - protein, 355 aa, Human
EPAGQRQPQQPPEVHEEPAAACACRPVCGRRRGRSAERQPAGAGGIMDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 11415 - protein, 363 aa, Human
RRDLRATAQRIGRPPPPSRALPLGPRFPARTRVSLRTHTRCTRQSGASPCPDSRRSSRAPATRPQAPVSAAGAAGPGRQKMAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 11416 - protein, 291 aa, Human
LTNPPPSGDRIGQGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCR

SEQ ID NO: 11417 - protein, 916 aa, Human [sequence omitted]

SEQ ID NO: 11418 - protein, 705 aa, Human
DMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 11419 - protein, 698 aa, Human
AGTAGFGLRRSGDLTMASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQVTNHGRGTEVLLEEPLPLETARESPSFKLEPMETERSPGPRLQELLGPSPQRDPQAVKERALSAPWLSLFPPEGNMEDKEMTGPQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 11420 - protein, 412 aa, Human
EVALEAPRNECGVWLQGMMAAKVVPMPPKPKQSFILRVPPDSKLGQDLLRDATNGPKTIHQLVLEHFLTFLPKPSLVQPSQKVKETLVIMKDVSSSLQNRVHPRPLVKLLPKGVQKEQETVSLYLKANPEELVVFEDLNVFHCQEECVSLDPTQQLTSEKEDDSSVGEMMLLAVNGSNPEGEDPEREPVENEDYREKSSDDDEMDSSLVSQQPPDNQEKERLNTSIPQKRKMRNLLVTIENDTPLEELSKYVDISIIALTRNRRTRRWYTCPLCGKQFNESSYLISHQRTHTGEKPYDCNHCGKSFNHKTNLNKHERIHTGEKPYSCSQCGKNFRQNSHRSRHEGIHIREKIFKCPECGKTFPKNEEFVLHLQSHEAERPYGCKKCGRRFGRLSNCTRHEKTHSACKTRKQK

SEQ ID NO: 11421 - protein, 634 aa, Human
APGLDNMASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVLFETFGYHFRDEACFPSPGAGALHWELLSRGLLHGCIHAIGVHLFVMSQVRSRSTFLKVGQSIMHGKDLEVEKALKERMIHSVMPRIIADDLMKQGDEESENSVKRHATSSPKNRKKKSSIQKAPIAFRPFKMQQIEEVSILFADIVGFTKMSANKSAHALVGLLNDLFGRFDRLCEETKCEKISTLGDCYYCVAGCPEPRADHAYCCIEMGLGMIKAIEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLK

SEQ ID NO: 11422 - protein, 803 aa, Human
MAKTPSDHLLSTLEELVPYDFEKFKFKLQNTSVQKEHSRIPRSQIQRARPVKMATLLVTYYGEEYAVQLTLQVLRAINQRLLAEELHRAAIQEYSTQENGTDDSAASSSLGENKPRSLKTPDHPEGNEGNGPRPYGGGAASLRCSQPEAGRGLSRKPLSKRREKASEGLDAQGKPRTRSPALPGGRSPGPCRALEGGQAEVRLRRNASSAGRLQGLAGGAPGQKECRPFEVYLPSGKMRPRSLEVTISTGEKAPANPEILLTLEEKTAANLDSATEPRARPTPDGGASADLKEGPGNPEHSVTGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNVPELIGAQAHAGGENPVGMLPMDPYLGIQIFFAVNVILDAETAYPNLIFSDDLKSVRLGNKWERLPDGPQRFDSCIIVLGSPSFLSGRRYWEVEVGDKTAWILGACKTSISRKGNMTLSPENGYWVVIMMKENEYQASSVPPTRLLIKEPPKRVGIFVDYRVGSISFYNVTARSHIYTFASCSFSGPLQPIFSPGTRDGGKNTAPLTICPVGGQGPD

SEQ ID NO: 11423 - protein, 853 aa, Human
TRASSTMSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 11424 - protein, 772 aa, Human
SPVKINQISLDESGEHMGVCSEDGKVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMNSAAQFCNICSAKNRGPGSAILEMKK

SEQ ID NO: 11425 - protein, 713 aa, Human
RRQPRCALCSSQLPGPAAMADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLAESEQAPPTEPKAEEPLAAVTPAVGLDLGMDTRAEEPVEEAVIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 11426 - protein, 341 aa, Human
VCKSQRCKKQRLQQQQQQRRWQQQQQRRQQQQQRRHRWQQQHHQQQQQKKILIKSSPKLSVYPDPHLHSSQERERGKGGRKKKKPNNLAETSQRMLQNSAVLLVLVISASATHEAEQNDSVSPRKSRVAAQNSAEVVRCLNSALQVGCGAFACLENSTCDTDGMYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 11427 - protein, 382 aa, Human
THHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 11428 - protein, 187 aa, Human
QLSAPASCSCTMKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 11429 - protein, 493 aa, Human
QKASERASELPAVGERGDRKSERGEGARGEKVTVKCAAPLTGALSPAPRVMATAASNHYSLLTSSASIVHAEPPGGMQQGAGGYREAQSLVQGDYGALQSNGHPLSHAHQWITALSHGGGGGGGGGGGGGGGGGGGGGDGSPWSTSPLGQPDIKPSVVVQQGGRGDELHGPGALQQQHQQQQQQQQQQQQQQQQQQQQQRPPHLVHHAANHHPGPGAWRSAAAAAHLPPSMGASNGGLLYSQPSFTVNGMLGAGGQPAGLHHHGLRDAHDEPHHADHHPHPHSHPHQQPPPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 11430 - protein, 182 aa, Human
RCDPRTPANMALRVVRSVRALLCTLRAVPLPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 11431 - protein, 606 aa, Human
FSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 11432 - protein, 307 aa, Human
RAIEMFMNKNPPARRTLADIIMEKLTEKQTEVETVMSEVSGFPMPQLDPRVLEVYRGVREVLSKYRSGKLPKAFKIIPALSNWEQILYVTEPEAWTAAAMYQATRIFASNLKERMAQRFYNLVLLPRVRDDVAEYKRLNFHLYMALKKALFKPGAWFKGILIPLCESGTCTLREAIIVGSIITKCSIPVLHSSAAMLKIAEMEYSGANSIFLRLLLDKKYALPYRVLDALVFHFLGFRTEKRELPVLWHQCLLTLVQRYKADLATDQKEALLELLRLQPHPQLSPEIRRELQSAVPRDVEDVPITVE

SEQ ID NO: 11433 - protein, 2733 aa, Human
ISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEGNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 11434 - protein, 870 aa, Human
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 11435 - protein, 812 aa, Human
CLDQDLGLCERIAGPGEVLESTMAEQVLPQALYLSNMRKAVKIRERTPEDIFKPTNGIIHHFKTMHRYTLEMFRTCQFCPQFREIIHKALIDRNIQATLESQKKLNWCREVRKLVALKTNGDGNCLMHATSQYMWGVQDTDLVLRKALFSTLKETDTRNFKFRWQLESLKSQEFVETGLCYDTRNWNDEWDNLIKMASTDTPMARSGLQYNSLEEIHIFVLCNILRRPIIVISDKMLRSLESGSNFAPLKVGGIYLPLHWPAQECYRYPIVLGYDSHHFVPLVTLKDSGPEIRAVPLVNRDRGRFEDLKVHFLTDPENEMKEKLLKEYLMVIEIPVQGWDHGTTHLINAAKLDEANLPKEINLVDDYFELVQHEYKKWQENSEQGRREGHAQNPMEPSVPQLSLMDVKCETPNCPFFMSVNTQPLCHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFCTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHPNQRMGPGAHRGEPAPEDPPKQRCRAPACDHFGNAKCNGYCNECFQFKQMYG

SEQ ID NO: 11436 - protein, 356 aa, Human
ETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 11437 - protein, 503 aa, Human
RRRSGLEPATVGSSMALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 11438 - protein, 211 aa, Human
MAQAKINAKANEGRFCRSSSMADRSSRLLESLDQLELRVEALREAATAVEQEKEILLEMIHSIQNSQDMRQISDGEREELNLTANRLMGRTLTVEVSVETIRNPQQQESLKHATRIIDEVVNKFLDDLGNAKSHLMSLYSACSSEVPHGPVDQKFQSIVIGCALEDQKKIKRRLETLLRNIENSDKAIKLLEHSKGAGSKTLQQNAESRFN

SEQ ID NO: 11439 - protein, 2446 aa, Human
MDTGDTALGQKATSRSGETDKASGRWRQEQSAVIKMSTFGSHEGQRQPQIEPEQIGNTASAQLFGSGKLASPSEVVQQVAEKQYPPHRPSPYSCQHSLSFPQHSLPQGVMHSTKPHQSLEGPPWLFPGPLPSVASEDLFPFPIHGHSGGYPRKKISSLNPAYSQYSQKSIEQAEEAHKKEHKPKKPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFPPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENLEDLHKAAEKHSMSSISTDHQFSDAEESDGEDGDDNDDDDEDEDDFDDQGDLTPKTRSRSTSPQPPRFSSLPVNVGAVPHGVPSDSSLGHSSLISYLVTLPSIRVTQLMTPSDSCEDTQMTEYQRLFQSKSTDSEPDKDRLDIPSCMDEECMLPSEPSSSPRDFSPSSHHSSPGYDSSPCRDNSPKRYLIPKGDLSPRRHLSPRRDLSPMRHLSPRKEAALRREMSQRDVSPRRHLSPRRPVSPGKDITARRDLSPRRERRYMTTIRAPSPRRALYHNPPLSMGQYLQAEPIVLGPPNLRRGLPQVPYFSLYGDQEGAYEHPGSSLFPEGPNDYVFSHLPLHSQQQVRAPIPMVPVGGIQMVHSMPPALSSLHPSPTLPLPMEGFEEKKGASGESFSKDPYVLSKQHEKRGPHALQSSGPPSTPSSPRLLMKQSTSEDSLNATEREQEENIQTCTKAIASLRIATEEAALLGPDQPARVQEPHQNPLGSAHVSIRHFSRPEPGQPCTSATHPDLHDGEKDNFGTSQTPLAHSTFYSKSCVDDKQLDFHSSKELSSSTEESKDPSSEKSQLH

SEQ ID NO: 11440 - protein, 435 aa, Human
IFRQTSGRTRSLPRSRCSLSLSRHMATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 11441 - protein, 113 aa, Human
MEDYQAAEETAFVVDEVSNIVKEAIESAIGGNAYQHSKVNQWTTNVVEQTLSQLTKLGKPFKYIVTCVIMQKNGAGLHTASSCFWDSSTDGSCTVRWENKTMYCIVSAFGLSI

SEQ ID NO: 11442 - protein, 545 aa, Human
GRQDWDRGPENGAAGTREAWNGASAMSNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 11443 - protein, 531 aa, Human
VSQSMENQEKASIAGHMFDVVVIGGGISGLSAAKLLTEYGVSVLVLEARDRVGGRTYTIRNEHVDYVDVGGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 11444 - protein, 706 aa, Human
MATANFGKIQIGIYVEIKRSDGRIHQAMVTSLNEDNESVTVEWIENGDTKGKEIDLESIFSLNPDLVPDEEIEPSPETPPPPASSAKVNKIVKNRRTVASIKNDPPSRDNRVVGSARARPSQFPEQSSSAQQNGSVSDISPVQAAKKEFGPPSRRKSNCVKEVEKLQEKREKRRLQQQELREKRAQDVDATNPNYEIMCMIRDFRGSLDYRPLTTADPIDEHRICVCVRKRPLNKKETQMKDLDVITIPSKDVVMVHEPKQKVDLTRYLENQTFRFDYAFDDSAPNEMVYRFTARPLVETIFERGMATCFAYGQTGSGKTHTMGGDFSGKNQDCSKGIYALAARDVFLMLKKPNYKKLELQVYATFFEIYSGKVFDLLNRKTKLRVLEDGKQQVQVVGLQEREVKCVEDVLKLIDIGNSCRTSGQTSANAHSSRSHAVFQIILRRKGKLHGKFSLIDLAGNERGADTSSADRQTRLEGAEINKSLLALKECIRALGRNKPHTPFRASKLTQVLRDSFIGENSRTCMIATISPGMASCENTLNTLRYANRVKELTVDPTAAGDVRPIMHHPPNQIDDLETQWGVGSSPQRDDLKLLCEQNEEEVSPQLFTFHEAVSQMVEMEEQVVEDHRAVFQESIRWLEDEKALLEMTEEVDYDVDSYATQLEAILEQKIDILTELRDKVKSFRAALQEEEQASKQINPKRPRAL

SEQ ID NO: 11445 - protein, 397 aa, Human
APGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQDMRLQMNQTLPVQV

SEQ ID NO: 11446 - protein, 702 aa, Human
APSRFPRRCPRGAPGPARPGPRPPPPPPRAGGGGRARGPGRPQPQPRRAPPPVECMRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 11447 - protein, 702 aa, Human; identical to SEQ ID NO: 11446

SEQ ID NO: 11448 - protein, 436 aa, Human
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLDMQVSSWESQGDLGSSQESSLPLPLDSSSVRILSLVGGMSFSCLLQSTCLAWSFTSRLDKQNFKTGPKRGPLPASEDIKLQT

SEQ ID NO: 11449 - protein, 232 aa, Human
RPEHRSHKAMACLGFQRHKAQLNLAARTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 11450 - protein, 206 aa, Human
LFIKNSEGGMPAPSMDCDVSTLVACVVDVEVFTNQEVKEKFEGLFRTYDDCVTFQLFKSFRRVRINFSNPKSAARARIELHETQFRGKKLKLYFAQVQTPETDGDKLHLAPPQPAKQFLISPPSSPPVGWQPINDATPVLNYDLLYAVAKLGPGEKYELHAGTESTPSVVVHVCDSDIEEEEDPKTSPKPKIIQTRRPGLPPSVSN

SEQ ID NO: 11451 - protein, 238 aa, Human
FRDSYRVACISRADSHVRAPDRHCPAAGQLDVLGNSAATATTAYVLASRSRVKGFLSQPPIEAQSLPRAPPLFDAQLLPGAQPPFHAQSPLDSQPQPSGQPWNFHASTSWYWRQSSDRFPRHQKSFNPSVKNSYYPRKYDAKFTDFSLPPSRKQKKKKRKEPVFHFFCDTCDRGFKNREKYDKHMSEHTKCPEVDCSFTAHKKIVQFHWRNMHAPGMKKIKLDTPEEIARWRGERRKN

SEQ ID NO: 11452 - protein, 591 aa, Human
QFFHLTQVCFSGGLQNQHPHFRDYLRAFWTKLPTRIREEEMAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 11453 - protein, 447 aa, Human
RRPRPGWVPTALGGAMDEAVGDLKQALPCVAESPTVHVEVHQRGSSTAKKEDINLSVRKLLNRHNIVFGDYTWTEFDEPFLTRNVQSVSIIDTELKVKDSQPIDLSACTVALHIFQLNEDGPSSENLEEETENIIAANHWVLPAAEFHGLWDSLVYDVEVKSHLLDYVMTTLLFSDKNVNSNLITWNRVVLLHGPPGTGKTSLCKALAQKLTIRLSSRYRYGQLIEINSHSLFSKWFSESGKLVTKMFQKIQDLIDDKDALVFVLIDEVESLTAARNACRAGTEPSDAIRVVNAVLTQIDQIKRHSNVVILTTSNITEKIDVAFVDRADIKQYIGPPSAAAIFKIYLSCLEELMKCQIIYPRQQLLTLRELEMIGFIENNVSKLSLLLNDISRKSEGLSGRVLRKLPFLAHALYVQAPTVTIEGFLQALSLAVDKQFEERKKLAAYI

SEQ ID NO: 11454 - protein, 541 aa, Human
PLGPAPCPPGQPGQPGRHQGSCPMDRAPQRQHRASRELLAAKKTHTSQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 11455 - protein, 170 aa, Human
HSSPVPASSAPESLVGLQEGKSTEQGNHDQLKELYSAGNLTVLATDPLLHQDPVQLDFHFRLTSQTSAHWHGLLCDRRLFLDIPYQALDQGNRESLTATLEYVEEKTNVDSVFVNFQNDRNDRGALLRAFSYMGFEVVRPDHPALPPLDNVIFMVYPLERDVGHLPSEPP

SEQ ID NO: 11456 - protein, 347 aa, Human
DTFLKRLPVVFRITPTVRFSTMDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQIFDFSLTEEEMKDIEALNKNVRFVELLMWRDHPEYPFHDEY

SEQ ID NO: 11457 - protein, 1058 aa, Human
SSTASTSQTWPCGAIPGSPSRPGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMETGVIDPEIQRYNTPGFSGCLSGVRFNNVAPLKTHFRTPRPMTAELAEALRVQGELSESNCGAMPRLVSEVPPELDPWYLPPDFPYYHDEGWVAILLGFLVAFLLLGLVGMLVLFYLQNHRYKGSYHTNEPKAAHEYHPGSKPPLPTSGPAQVPTPTAAPNQAPASAPAPAPTPAPAPGPRDQNLPQILEESRSE

SEQ ID NO: 11458 - protein, 320 aa, Human
ADGTEGGSERAVSKPARAVGSRGQPRFLRSLRPPPWSPQRLRCPEDRTRPGPAMASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTPSGKGPHICFDLQVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 11459 - protein, 806 aa, Human
LPGTSARVREPPTPSRSQQSPRLAGVRIHCSPLVESAVPLRGKMNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 11460 - protein, 363 aa, Human
GAKEMRMEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLAQVLGQPHKKSL

SEQ ID NO: 11461 - protein, 227 aa, Human
MEGQSGRCKIVVVGDAECGKTALLQVFAKDAYPGSYVPTVFENYTASFEIDKRRIELNMWDTSGSSYYDNVRPLAYPDSDAVLICFDISRPETLDSVLKKWQGETQEFCPNAKVVLVGCKLDMRTDLATLRELSKQRLIPVTHEQGTVLAKQVGAVSYVECSSRSSERSVRDVFHVATVASLGRGHRQLRRTDSRRGMQRSAQLSGRPDRGNEGEIHKDRAKSCNLM

SEQ ID NO: 11462 - protein, 335 aa, Human
RQVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 11463 - protein, 1821 aa, Human
LGLFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFALFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSGHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 11464 - protein, 1821 aa, Human; identical to SEQ ID NO: 11463

SEQ ID NO: 11465 - protein, 1821 aa, Human; identical to SEQ ID NO: 11463

SEQ ID NO: 11466 - protein, 1821 aa, Human; identical to SEQ ID NO: 11463

SEQ ID NO: 11467 - protein, 325 aa, Human
HAFSNIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 11468 - protein, 325 aa, Human; identical to SEQ ID NO: 11467

SEQ ID NO: 11469 - protein, 177 aa, Human
YRKALSRRKSALGPPSRRQLPRVRSDQRALGGTRETQHPAGLSVAKSNMKILVALAVFFLVSTQLFAEEIGANDDLNYWSDWYDSDQIKEELPEPFEHLLQRIARRPKPQQFFGLMGKRDADSSIEKQVALLKALYGHGQISHKRHKTDSFVGLMGKRALNSVAYERSAMQNYERRR

SEQ ID NO: 11470 - protein, 177 aa, Human; identical to SEQ ID NO: 11469

SEQ ID NO: 11471 - protein, 177 aa, Human; identical to SEQ ID NO: 11469

SEQ ID NO: 11472 - protein, 177 aa, Human; identical to SEQ ID NO: 11469

SEQ ID NO: 11473 - protein, 505 aa, Human
DYILLPFKKMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRFHFCRMSWAEANSQCQTQSVPFWRRVDHLLIRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 11474 - protein, 464 aa, Human
VGRQTRERLRLVQGSCGLAALASAVVPARMPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGLSAHTHVELPYYSKFILIAAYLASYNPARTDKRFFLKHHGKIKKTNFLKKHEKTSNHLLGPKPFPLDRLLAILYSIVDSRVAPTANIFSQITSLVTLQLLTLVGHDDQLDGPKYKCTVSLDFIRAIARTVNFDIIKYLYDFL

SEQ ID NO: 11475 - protein, 441 aa, Human
PSLLEQLPSGPAPPPESMAGTRWVLGALLRGCGCNCSSCRRTGAACLPFYSAASYSALRASLLPQSLAAAAAVPTRSYSQESKTTYLEDLPPPPEYELAPSKLEEEVDDVFLIRAQGLPWSCTMEDVLNFFSDCRIRNGENGIHFLLNRDGKRRGDALIEMESEQDVQKALEKHRMYMGQRYVEVYEINNEDVDALMKSLQVKSSPVVNDGVVRLRGLPYSCNEKDIVDFFAGLNIVDITFVMDYRGRRKTGEAYVQFEEPEMANQALLKHREEIGNRYIEIFPSRRNEVRTHVGSYKGKKIASFPTAKYITEPEMVFEEHEVNEDIQPMTAFESEKEIELPKEVPEKLPEAADFGTTSSLHFVHMRGLPFQANAQDIINFFAPLKPVRITMEYSSSGKATGEADVHFETHEDAVAAMLKDRSHVHHRYIELFLNSCPKGK

SEQ ID NO: 11476 - protein, 702 aa, Human
QHRTMQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 11477 - protein, 702 aa, Human; identical to SEQ ID NO: 11476

SEQ ID NO: 11478 - protein, 666 aa, Human
FLLPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 11479 - protein, 300 aa, Human
QGATLFCYPQRPAAAAPSAAMKFRAKIVDGACLNHFTRISNMIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDVSIYLPVLKTMKSVVEKMKNISNHLVIEANLDGELNLKIETELVCVTTHFKDLGNPPLASESTHEDRNVEHMAEVHIDIRKLLQFLAGQQVNPTKALCNIVNNKMVHFDLLHEDVSLQYFIPALS

SEQ ID NO: 11480 - protein, 184 aa, Human
SEMSQKPAKEGPRLSKNQKYSEHFSIHCCPPFTFLNSKKEIVDRKYSICKSGCFYQKKEEDWICCACQKTRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRF

SEQ ID NO: 11481 - protein, 226 aa, Human
LAIQENTMKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQVWPISCTLGATFGYVAGLVISPLWIYWNRKQLTYKNN

SEQ ID NO: 11482 - protein, 235 aa, Human
GAARPGSGSRPQPRAQGPPGPSRVSMPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAEKVASRIAEGFSDTALIMVDNTKFTMDCVAPTIHVYEHHENRWRCRDPHHDYCEDWPEAQRISASLLDSRSYETLVDFDNHLDDIRNDWTNPEINKAVLHLC

SEQ ID NO: 11483 - protein, 439 aa, Human
GTRAARRRQDGGRMCDRNGGRRLRQWLIEQIDSSMYPGLIWENEEKSMFRIPWKHAGKQDYNQEVDASIFKAWAVFKGKFKEGDKAEPATWKTRLRCALNKSPDFEEVTDRSQLDISEPYKVYRIVPEEEQKCKLGVATAGCVNEVTEMECGRSEIDELIKEPSVDDYMGMIKRSPSPPEACRSQLLPDWWAQQPSTGVPLVTGYTTYDAHHSAFSQMVISFYYGGKLVGQATTTCPEGCRLSLSQPGLPGTKLYGPEGLELVRFPPADAIPSERQRQVTRKLFGHLERGVLLHSSRQGVFVKRLCQGRVFCSGNAVVCKGRPNKLERDEVVQVFDTSQFFRELQQFYNSQGRLPDGRVVLCFGEEFPDMAPLRSKLILVQIEQLYVRQLAEEAGKSCGAGSVMQAPEEPPPDQVFRMFPDICASHQRSFFRENQQITV

SEQ ID NO: 11484 - protein, 179 aa, Human
RAVAAGSGGRMLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWKTVVGGAMFFIGFTALVIMWQKHYVYGPLPQSFDKEWVAKQTKRMLDMKVNPIQGLASKWDYEKNEWKK

SEQ ID NO: 11485 - protein, 385 aa, Human
GGSSHPMSSAPEKQQPPHGGGGGGGGGGGAAMDPASSGPSKAKKTNAGIRRPEKPPYSYIALIVMAIQSSPTKRLTLSEIYQFLQSRFPFFRGSYQGWKNSVRHNLSLNECFIKLPKGLGRPGKGHYWTIDPASEFMFEEGSFRRRPRGFRRKCQALKPMYSMMNGLGFNHLPDTYGFQGSAGGLSCPPNSLALEGGLGMMNGHLPGNVDGMALPSHSVPHLPSNGGHSYMGGCGGAAAGEYPHHDSSVPASPLLPTGAGGVMEPHAVYSGSAAAWPPSASAALNSGASYIKQQPLSPCNPAANPLSGSLSTHSLEQPYLHQNSHNAPAELQGIPRYHSQSPSMCDRKEFVFSFNAMASSSMHSAGGGSYYHQQVTYQDIKPCVM

SEQ ID NO: 11486 - protein, 206 aa, Human
FSTADRPTQPTANQDLTGTRKGAIMKSFLLVVNALALTLPFLAVEVQNQKQPACHENDERPFYQKTAPYVPMYYVPNSYPYYGTNLYQRRPAIAINNPYVPRTYYANPAVVRPHAQIPQRQYLPNSHPPTVVRRPNLHPSFIAIPPKKIQDKIIIPTINTIATVEPTPAPATEPTVDSVVTPEAFSESIITSTPETTTVAVTPPTA

SEQ ID NO: 11487 - protein, 230 aa, Human
DLVAMKVLILACLVALALARETIESLSSSEESITEYKQKVEKVKHEDQQQGEDEHQDKIYPSFQPQPLIYPFVEPIPYGFLPQNILPLAQPAVVLPVPQPEIMEVPKAKDTVYTKGRVMPVLKSPTIPFFDPQIPKLTDLENLHLPLPLLQPLMQQVPQPIPQTLALPPQPLWSVPQPKVLPIPQQVVPYPQRAVPVQALLLNQELLLNPTHQIYPVTQPLAPVHNPISV

SEQ ID NO: 11488 - protein, 412 aa, Human
MGCDRNCGLIAGAVIGAVLAVFGGILMPVGDLLIQKTIKKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 11489 - protein, 123 aa, Human
SAMFDRENKAGVNFSEFTGVWKYITDWQNVFRTYDRDNSGMIDKNELKQALSGFGYRLSDQFHDILIRKFDRQGRGQIAFDDFIQGCIVLQRLTDIFRRYDTDQDGWIQVSYEQYLSMVFSIV

SEQ ID NO: 11490 - protein, 675 aa, Human
DGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMPRGHQTDLRARTRHASAASHPSSATGRSPAPPHAAAPHPGPRSLCSPTWTSPPAT

SEQ ID NO: 11491 - protein, 646 aa, Human
WYPKSGKLLYSLAFNARFLRHLWFLISSMSTRMITGSMVPLLQVISRGSPMSFEDSSRIIPLFYLFSSLFSHSLISIHDNEFFGDPIEVVGQRQSSMMPFTLEELIMLSRCLRDACLGIIKLAYPETKPEVREEYITAFQSIGVTTSSEMQQCIQMEQKRWIQLFKVITNLVKMLKSRDTRRNFCPPNHWLSEQEDIKADKVTQLYVPASRHVWRFRRMGRIGPLQSTLDVGLESPPLSVSEERQLAVLTELPFVVPFEERVKIFQRLIYADKQEVQGDGPFLDGINVTIRRNYIYEDAYDKLSPENEPDLKKRIRVHLLNAHGLDEAGIDGGGIFREFLNELLKSGFNPNQGFFKTTNEGLLYPNPAAQMLVGDSFARHYYFLGRMLGKALYENMLVELPFAGFFLSKLLGTSADVDIHHLASLDPEVYKNLLFLKSYEDDVEELGLNFTVVNNDLGEAQVVELKFGGKDIPVTSANRIAYIHLVADYRLNRQIRQHCLAFRQGLANVVSLEWLRMFDQQEIQVLISGAQVPISLEDLKSFTNYSGGYSADHPVIKVFWRVVEGFTDEEKRKLLKFVTSCSRPPLLGFKELYPAFCIHNGGSDLERLPTASTCMNLLKLPEFYDETLLRSKLLYAIECAAGFELS

SEQ ID NO: 11492 - protein, 397 aa, Human
RGAQSRFGASTAQSPRPGRGRSQAAMAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHGVCFSASGSRVAWVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 11493 - protein, 361 aa, Human
EGCAAAVPGSLEAQKRKPSPGPGSLDLVSLGSGNSGSQRTVLIMDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 11494 - protein, 746 aa, Human
PSRLRHWGPRVPRASRRESAGALRGLERLVWEVVEPSHPPPRRREVSRPEHVDAHPPLSLMEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQRESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 11495 - protein, 520 aa, Human
KYWRKGKYSGKMQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 11496 - protein, 833 aa, Human
VVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDATWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRANLLLEDPEFI

SEQ ID NO: 11497 - protein, 267 aa, Human
GACQLREAAVRGRAQAADPSRSSGSPAPQLCGGAAVVGGCRILEMATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 11498 - protein, 803 aa, Human
ERYKGSGRVVRGAFRAGREQRQVMAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFGTSRHISVGPFPVVSLMVGSVVLSMAPDEHFLVSSSNGTVLNTTMIDTAARDTARVLIASALTLLVGIIQLIFGGLQIGFIVRYLADPLVGGFTTAAAFQVLVSQLKIVLNVSTKNYNGVLSIIYTLVEIFQNIGDTNLADFTAGLLTIVVCMAVKELNDRFRHKIPVPIPIEVIVTIIATAISYGANLEKNYNAGIVKSIPRGFLPPELPPVSLFSEMLAASFSIAVVAYAIAVSVGKVYATKYDYTIDGNQEFIAFGISNIFSGFFSCFVATTALSRTAVQESTGGKTQVAGIISAAIVMIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 11499 - protein, 252 aa, Human
SPRIRVGTETISAPKMLEEDMEVAIKMVVVGNGAVGKSSMIQRYCKGIFTKDYKKTIGVDFLERQIQVNDEDVRLMLWDTAGQEEFDAITKAYYRGAQACVLVFSTTDRESFEAVSSWREKVVAEVGDIPTVLVQNKIDLLDDSCIKNEEAEALAKRLKLRFYRTSVKEDLNVNEVFKYLAEKYLQKLKQQIAEDPELTHSSSNKIGVFNTSGGSHSGQNSGTLNGGDVINLRPNKQRTKKNRNPFSSCSIP

SEQ ID NO: 11500 - protein, 1035 aa, Human
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 11501 - protein, 587 aa, Human
QGWRENLCEEREGASREFKGRCEAIMDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 11502 - protein, 567 aa, Human
AVCCPPTCDPAPPPMRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPISITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 11503 - protein, 578 aa, Human
FFPRREMSYQGKKNIPRITSDRLLIKGGKIVNDDQSFYADIYMEDGLIKQIGENLIVPGGVKTIEAHSRMVIPGGIDVHTRFQMPDQGMTSADDFFQGTKAALAGGTTMIIDHVVPEPGTSLLAAFDQWREWADSKSCCDYSLHVDISEWHKGIQEEMEALVKDHGVNSFLVYMAFKDRFQLTDCQIYEVLSVIRDIGAIAQVHAENGDIIAEEQQRILDLGITGPEGHVLSRPEEVEAEAVNRAITIANQTNCPLYITKVMSKSSAEVIAQARKKGTVVYGEPITASLGTDGSHYWSKNWAKAAAFVTSPPLSPDPTTPDFLNSLLSCGDLQVTGSAHCTFNTAQKAVGKDNFTLIPEGTNGTEERMSVIWDKAVVTGKMDENQFVAVTSTNAAKVFNLYPRKGRIAVGSDADLVIWDPDSVKTISAKTHNSSLEYNIFEGMECRGSPLVVISQGKIVLEDGTLHVTEGSGRYIPRKPFPDFVYKRIKARSRLAELRGVPRGLYDGPVCEVSVTPKTVTPASSAKTSPAKQQAPPVRNLHQSGFSLSGAQIDDNIPRRTTQRIVAPPGGRANITSLG

SEQ ID NO: 11504 - protein, 507 aa, Human
HPAGWSARPSFLFPPAPVPSPRRCHPPPSALSTPPSPGEGGEFRKRRPRGTQQGHHLQRNMAGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGYNLKEEDGRYRDPTTVTTLRVPVFRPMDLMVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 11505 - protein, 526 aa, Human
GPPEKMGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 11506 - protein, 199 aa, Human
LSSCLCGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 11507 - protein, 642 aa, Human
SVFAGAPHLHQPTQIPRSDSARPRSPRLPGASREPAGRRTPTPSSLCPSTRAPRPFRDPCPAGSAANLPAMETPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 11508 - protein, 1052 aa, Human
MAGMDSGNLKTARLWRDAALRARKLRSNLRQLTLTAAGACPGAGADALESPASPQLVLPANLGDIEALNLGNNGLEEVPEGLGSALGSLRVLVLRRNRFARLPPAVAELGHHLTELDVSHNRLTALGAEVVSALRELRKLNLSHNQLPALPAQLGALAHLEELDVSFNRLAHLPDSLSCLSRLRTLDVDHNQLTAFPRQLLQLVALEELDVSSNRLRGLPEDISALRALKILWLSGAELGTLPAGFCELASLESLMLDNNGLQALPAQFSCLQRLKMLNLSSNLFEEFPAALLPLAGLEELYLSRNQLTSVPSLISGLGRLLTLWLDNNRIRYLPDSIVELTGLEELVLQGNQIAVLPDHFGQLSRVGLWKIKDNPLIQPPYEVCMKGIPYIAAYQKELAHSQPAVQPRLKLLLMGHKAAGKTLLRHCLTEERVEGCPGGGDKEKCYPPSPPPVSKGIEVTSWTADASRGLRFIVYDLAGDESYEVIQPFFLSPGALYVLVVNLATYEPRHFPTTVGSFLHRVGARVPHAVVCIVGTHADLCGERELEEKCLDIHRQIALQEKHDAEGLSRLAKVVDEALARDFELRSASPHAAYYGVSDKNLRRRKAHFQYLLNHRLQILSPVLPVSCRDPRHLRRLRDKLLSVAEHREIFPNLHRVLPRSWQVLEELHFQPPQAQRLWLSWWDSARLGLQAGLTEDRLQSALSYLHESGKLLYFEDSPALKEHVFHNLTRLIDILNVFFQRDPSLLLHKLLLGTSGEGKAEGESSPPMARSTPSQELLRATQLHQYVEGFLLHGLLPAHVIRLLLKPHVQAQQDLQLLLELLEKMGLCYCLNKPKGKPLNGSTAWYKFPCYVQNEVPHAEAWINGTNLAGQSFVAEQLQIEYSFPFTFPPGLFARYSVQINSHVVHRSDGKFQIFAYRGKVPVVVSYRPARGVLQPDTLSIASHASLPNIWTAWQAITPLVEELNVLLQEWPGLHYTVHILCSKCLKRGSPNPHAFPGELLSQPRPEGVAEIICPKNGSERVNVALVYPPTPTVISPCSKKNVGEKHRNQ

SEQ ID NO: 11509 - protein, 268 aa, Human
EEGRGLEDTNNKLKSSQKDKVRQFMIFTQSSEKTAVSCLSQNDWKLDVATDNFFQNPELYIRESVKGSLDRKKLEQLYNRYKDPQDENKIGIDGIQQFCDDLALDPASISVLIIAWKFRAATQCEFSKQEFMDGMTELGCDSIEKLKAQIPKMEQELKEPGRFKDFYQFTFNFAKNPGQKGLDLEMAIAYWNLVLNGRFKFLDLWNKFLLEHHKRSIPKDTWNLLLDFSTMIADDMSNYDEEGAWPVLIDDFVEFARPQIAGTKSTTV

SEQ ID NO: 11510 - protein, 498 aa, Human
TMRRQRNEVVVELRKNKRDEHLLKRRNVPHEDICEDSDIDGDYRVQNTSLEAIVQNASSDNQGIQLSAVQAARKLLSSDRNPPIDDLIKSGILPILVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPPMETIQEILPALCVLIHHTDVNILVDTVWALSYLTDAGNEQIQMVIDSGIVPHLVPLLSHQEVKVQTAALRAVGNIVTGTDEQTQVVLNCDALSHFPALLTHPKEKINKEAVWFLSNITAGNQQQVQAVIDANLVPMIIHLLDKGDFGTQKEAAWAISNLTISGRKDQVAYLIQQNVIPPFCNLLTVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 11511 - protein, 540 aa, Human
IPMALPYHIFLFTVLLPSFTLTAPPPCRCMTSSSPYQEFLWRMQRPGNIDAPSYRSLSKGTPTFTAHTHMPRNCYHSATLCMHANTHYWTGKMINPSCPGGLGVTVCWTYFTQTGMSDGGGVQDQAREKHVKEVISQLTRVHGTSSPYKGLDLSKLHETLRTHTRLVSLFNTTLTGLHEVSAQNPTNCWICLPLNFRPYVSIPVPEQWNNFSTEINTTSVLVGPLVSNLEITHTSNLTCVKFSNTTYTTNSQCIRWVTPPTQIVCLPSGIFFVCGTSAYRCLNGSSESMCFLSFLVPPMTIYTEQDLYSYVISKPRNKRVPILPFVIGAGVLGALGTGIGGITTSTQFYYKLSQELNGDMERVADSLVTLQDQLNSLAAVVLQNRRALDLLTAERGGTCLFLGEECCYYVNQSGIVTEKVKEIRDRIQRRAEELRNTGPWGLLSQWMPWILPFLGPLAAIILLLLFGPCIFNLLVNFVSSRIEAVKLQMEPKMQSKTKIYRRPLDRPASPRSDVNDIKGTPPEEISAAQPLLRPNSAGSS

SEQ ID NO: 11512 - protein, 550 aa, Human
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 11513 - protein, 479 aa, Human
GIAMETPGASASSLLLPAASRPPRKREAGEAGAATSKQRVLDEEEYIEGLQTVIQRDFFPDVEKLQAQKEYLEAEENGDLERMRQIAIKFGSALGKMSREPPPPYVTPATFETPEVHAGTGVVGNKPRPRGRGLEDGEAGEEEEKEPLPSLDVFLSRYTSEDNASFQEIMEVAKERSRARHAWLYQAEEEFEKRQKDNLELPSAEHQAIESSQASVETWKYKAKNSLMYYPEGVPDEEQLFKKPRQVVHKNTRFLRDPFSQALSRCQLQQAAALNAQHKQGKVGPDGKELIPQESPRVGGFGFVATPSPAPGVNESPMMTWGEVENTPLRVEGSETPYVDRTPGPAFKILEPGRRERLGLKMANEAAAKNRAKKQEALRRVTENLASLTPKGLSPAMSPALQRLVSRTASKYTDRALRASYTPSPARSTHLKTPASGLQTPTSTPAPGSATRTPLTQDPASITDNLLQLPARRKASDFF

SEQ ID NO: 11514 - protein, 205 aa, Human
MSAPAGGAASRRGAGRPCPFSIEHILSSLPERSLPARAACPPQPAGRQSPAKPEEPGAPEAAPCACCCCCGPRAAPCGPPEAAAGLGARLAWPLRLGPAVPLSLGAPAGGSGALPGAVGPGSQRRTRRHRTIFSEEQLQALEALFVQNQYPDVSTRERLAGRIRLREERVEVWFKNRRAKWRHQKRASASARLLPGVKKSPKGSC

SEQ ID NO: 11515 - protein, 238 aa, Human
LSAAPQLSDTADTMGFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEECVRSIQADGLVWGSSKLVPVGYGIKKLQIQCVVEDDKVGTDMLEEQITAFEDYVQSMDVAAFNKI

SEQ ID NO: 11516 - protein, 238 aa, Human; identical to SEQ ID NO: 11515

SEQ ID NO: 11517 - protein, 513 aa, Human
NTTEALPRMGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 11518 - protein, 506 aa, Human
SPLLNAGFNTYIFLSELVFSPLIFDLRDSSSHAYYRCCRRFLSPRGSLTCEGERGHRSRELAGTMYQSLAMAANHGPPPGAYEAGGPGAFMHGAGAASSPVYVPTPRVPSSVLGLSYLQGGGAGSASGGASGGSSGGAASGAGPGTQQGSPGWSQAGADGAAYTPPPVSPRFSFPGTTGSLAAAAAAAAAREAAAYSSGGGAAGAGLAGREQYGRAGFAGSYSSPYPAYMADVGASWAAAAAASAGPFDSPVLHSLPGRANPAARHPNLDMFDDFSEGRECVNCGAMSTPLWRRDGTGHYLCNACGLYHKMNGINRPLIKPQRRLSASRRVGLSCANCQTTTTTLWRRNAEGEPVCNACGLYMKLHGVPRPLAMRKEGIQTRKRKPKNLNKSKTPAAPSGSESLPPASGASSNSSNATTSSSEEMRPIKTEPGLSSHYGHSSSVSQTFSVSAMSGHGPSIHPVLSALKLSPQGYASPVSQSPQTSSKQDSWNSLVLADSHGDIITA

SEQ ID NO: 11519 - protein, 963 aa, Human
NSEKAGQRACSSWSSGRPGNLTLPSSCVVFVTALPLLLALKMEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEVRKLTQRYKK

SEQ ID NO: 11520 - protein, 963 aa, Human; identical to SEQ ID NO: 11519

SEQ ID NO: 11521 - protein, 374 aa, Human
LIEDEIATILKSTLKGLEYLHFMRKIHRDIKAGNILLNTEGHAKLADFGVAGQLTDTMAKRNTVIGTPFWMAPEVIQEIGYNCVADIWSLGITSIEMAEGKPPYADIHPMRAIFMIPTNPPPTFRKPELWSDDFTDFVKKCLVKNPEQRATATQLLQHPFIKNAKPVSILRDLITEAMEIKAKRHEEQQRELEEEEENSDEDELDSHTMVKTSVESVGTMRATSTMSEGAQTMIEHNSTMLESDLGTMVINSEDEEEEDGTMKRNATSPQVQRPSFMDYFDKQDFKNKSHENCNQNMHEPFPMSKNVFPDNWKVPQDGDFDFLKNLSLEELQMRLKALDPMMEREIEELRQRYTAKRQPILDAMDAKKRRQQNF

SEQ ID NO: 11522 - protein, 1049 aa, Human
GPAARRRRRRRRRMYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 11523 - protein, 741 aa, Human
SPSPYSRRRSPSYSRHSSYERGGDVSPSPYSSSSWRRSRSPYSPVLRRSGKSRSRSPYSSRHSRSRSRHRLSRSRSRHSSISPSTLTLKSSLAAELNKNKKARAAEAARAAEAAKAAEATKAAEAAAKAAKASNTSTPTKGNTETSASASQTNHVKDVKKIKIEHAPSPSSGGTLKNDKAKTKPPLQVTKVENNLIVDKATKKAVIVGKESKSAATKEESVSLKEKTKPLTPSIGAKEKEQHVALVTSTLPPLPLPPMLPEDKEADSLRGNISVKAVKKEVEKKLRCLLADLPLPPELPGGDDLSKSPEEKKTATQLHSKRRPKICGPRYGETKEKDIDWGKRCVDKFDIIGIIGEGTYGQVYKARDKDTGEMVALKKVRLDNEKEGFPITAIREIKILRQLTHQSIINMKEIVTDKEDALDFKKDKGAFYLVFEYMDHDLMGLLESGLVHFNENHIKSFMRQLMEGLDYCHKKNFLHRDIKCSNILLNNRGQIKLADFGLARLYSSEESRPYTNKVITLWYRPPELLLGEERYTPAIDVWSCGCILGELFTKKPIFQANQELAQLELISRICGSPCPAVWPDVIKLPYFNTMKPKKQYRRKLREEFVFIPAAALDLFDYMLALDPSKRCTAEQALQCEFLRDVEPSKMPPPDLPLWQDCHELWSKKRRRQKQMGMTDDVSTIKAPRKDLSLGLDDSRTNTPQGVLPSSQLKSQGSSNVAPGEKQTDPSTPQQESSKPLGG

SEQ ID NO: 11524 - protein, 741 aa, Human; identical to SEQ ID NO: 11523

SEQ ID NO: 11525 - protein, 455 aa, Human
STHTKKPAREGGGKAGPFKKAITTTFAARMPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 11526 - protein, 383 aa, Human
IGWPVARATGSRKGCGGSEWFLQSFIWKGLCSWGKMAHSQNSLELPININATQITTAYGHRALPKLKEELQSEDLQTRQKALMALCDLMHDPECIYKAMNIGCMENLKALLKDSNSMVRIKTTEVLHITASHSVGRYAFLEHDIVLALSFLLNDPSPVCRGNLYKAYMQLVQVPRGAQEIISKGLISSLVWKLQVEVEEEEFQEFILDTLVLCLQEDATEALGSNVVLVLKQKLLSANQNIRSKAARALLNVSISREGKKQVCHFDVIPILVHLLKDPVEHVKSNAAGALMFATVITEGKYAALEAQAIGLLLELLHSPMTIARLNATKALTMLAEAPEGRKALQTHVPTFRAMEVETYEKPQVAEALQRAARIAISVIEFKP

SEQ ID NO: 11527 - protein, 1287 aa, Human
DGPRAQPGGAGKAGRAMVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKNDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 11528 - protein, 358 aa, Human
CQTMGCRQSSEEKEAARRSRRIDRHLRSESQRQRREIKLLLLGTSNSGKSTIVKQMKIIHSGGFNLEACKEYKPLIIYNAIDSLTRIIRALAALRIDFHNPDRAYDAVQLFALTGPAESKGEITPELLGVMRRLWADPGAQACFSRSSEYHLEDNAAYYLNDLERIAAADYIPTVEDILRSRDMTTGIVENKFTFKELTFKMVDVGGQRSERKKWIHCFEGVTAIIFCVELSGYDLKLYEDNQTSRMAESLRLFDSICNNNWFINTSLILFLNKKDLLAEKIRRIPLTICFPEYKGQNTYEEAAVYIQRQFEDLNRNKETKEIYSHFTCATDTSNIQFVFDAVTDVIIQNNLKYIGLC

SEQ ID NO: 11529 - protein, 264 aa, Human
DPVSGCGGKMAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVMLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 11530 - protein, 589 aa, Human
ERRESPARPTAMRQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 11531 - protein, 625 aa, Human
GGGGVRRRRGTRRSEPGDSRSAMAPIGLKAVVGEKIMHDVIKKVKKKGEWKVLVVDQLSMRMLSSCCKMTDIMTEGITIVEDINKRREPLPSLEAVYLITPSEKSVHSLISDFKDPPTAKYRAAHVFFTDSCPDALFNELVKSRAAKVIKTLTEINIAFLPYESQVYSLDSADSFQSFYSPHKAQMKNPILERLAEQIATLCATLKEYPAVRYRGEYKDNALLAQLIQDKLDAYKADDPTMGEGPDKARSQLLILDRGFDPSSPVLHELTFQAMSYDLLPIENDVYKYETSGIGEARVKEVLLDEDDDLWIALRHKHIAEVSQEVTRSLKDFSSSKRMNTGEKTTMRDLSQMLKKMPQYQKELSKYSTHLHLAEDCMKHYQGTVDKLCRVEQDLAMGTDAEGEKIKDPMRAIVPILLDANVSTYDKIRIILLYIFLKNGITEENLNKLIQHAQIPPEDSEIITNMAHLGVPIVTDSTLRRRSKPERKERISEQTYQLSRWTPIIKDIMEDTIEDKLDTKHYPYISTRSSASFSTTAVSARYGHWHKNKAPGEYRSGPRLIIFILGGVSLNEMRCAYEVTQANGKWEVLIGSTHILTPTKFLMDLRHPDFRESSRVSFEDQAPTME

SEQ ID NO: 11532 - protein, 464 aa, Human
KSSSGEACKDSRIGGMMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 11533 - protein, 1014 aa, Human
LLPERMSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQVPEGLCASSPTLTSPMEYPSPVNSLHTPPLHRHNVFKRHSMREEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 11534 - protein, 370 aa, Human
CEIFREEFLFSSLQEGRDKDTFSKMAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 11535 - protein, 1093 aa, Human
MSWFNASQLSSFAKQALSQAQKSIDRVLDIQEEEPSIWAETIPYGEPGISSPVSGGWDTSTWGLKSNTEPQSPPIASPKAITKPVRRTVVDESENFFSAFLSPTDVQTIQKSPVVSKPPAKSQRPEEEVKSSLHESLHIGQSRTPETTESQVKDSSLCVSGETLAAGTSSPKTEGKHEETVNKESDMKVPTVSLKVSESVIDVKTTMESISNTSTQSLTAETKDIALEPKEQKHEDRQSNTPSPPVSTFSSGTSTTSDIEVLDHESVISESSASSRQETTDSKSSLHLMQTSFQLLSASACPEYNRLDDFQKLTESCCSSDAFERIDSFSVQSLDSRSVSEINSDDELSGKGYALVPIIVNSSTPKSKTVESAEGKSEEVNETLVIPTEEAEMEESGRSATPVNCEQPDILVSSTPINEGQTVLDKVAEQCEPAESQPEALSEKEDVCKTVEFLNEKLEKREAQLLSLSKEKALLEEAFDNLKDEMFRVKEESSSISSLKDEFTQRIAEAEKKVQLACKERDAAKKEIKNIKEELATRLNSSETADLLKEKDEQIRGLMEEGEKLSKQQLHNSNIIKKLRAKDKENENMVAKLNKKVKELEEELQHLKQVLDGKEEVEKQHRENIKKLNSMVERQEKDLGRLQVDMDELEEKNRSIQAALDSAYKELTDLHKANAAKDSEAQEAALSREMKAKEELSAALEKAQEEARQQQETLAIQVGDLRLALQRTEQAAARKEDYLRHEIGELQQRLQEAENRNQELSQSVSSTTRPLLRQIENLQATLGSQTSSWEKLEKNLSDRLGESQTLLAAAVERERAATEELLANKIQMSSMESQNSLLRQENSRFQAQLESEKNRLCKLEDENNRYQVELENLKDEYVRTLEETRKEKTLLNSQLEMERMKVEQERKKAIFTQETIKEKERKPFSVSSTPTMSRSSSISGVDMAGLQTSFLSQDESHDHSFGPMPISANGSNLYDAVRMGAGSSIIENLQSQLKLREGEITHLQLEIGNLEKTRSIMAEELVKLTNQNDELEEKVKEIPKLRTQLRDLDQRYNTILQMYGEKAEEAEELRLDLEDVKNMYKTQIDELLRQSLS

SEQ ID NO: 11536 - protein, 442 aa, Human
MAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 11537 - protein, 107 aa, Human
DRAMWGDLWLLPPASANPGTGTEAEFEKAAEEVRHLKTKPSDEEMLFIYGHYKQATVGDINTERPGMLDFTGKAKWDAWNELKGTSKEDAMKAYINKVEELKKKYGI

SEQ ID NO: 11538 - protein, 637 aa, Human
ELQQVSQQGLFRMIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 11539 - protein, 637 aa, Human; identical to SEQ ID NO: 11538

SEQ ID NO: 11540 - protein, 523 aa, Human
RLVKQMDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 11541 - protein, 419 aa, Human
LPSKMSPFLYLVLLVLGLHATIHCASPEGKVTACHSSQPNATLYKMSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 11542 - protein, 753 aa, Human
RRSQDPGCCLGPLPTMTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 11543 - protein, 167 aa, Human
GTRRAGGCRMMRFMLLFSRQGKLRLQKWYLATSDKERKKMVRELMQVVLARKPKMCSFLEWRDLKVVYKRYASLYFCCAIEGQDNELITLELIHRYVELLDKYFGSVCELDIIFNFEKAYFILDEFLMGGDVQDTSKKSVLKAIEQADLLQEEDESPRSVLEEMGLA

SEQ ID NO: 11544 - protein, 547 aa, Human
CRQRPVGVSMPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 11545 - protein, 901 aa, Human
GAAPTPLSREDAGGAGAASRNPAPAAAVVPAYTGFRGPGRQCPGSSRRRRLGTMNSSSANITYASRKRRKPVQKTVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQNEKFFRNDFSGEVDFRDIDLTDEILTYVQDSLSKSPFIPSDYQQQQSLALNSSCMVQEHLHLEQQQQHHQKQVVVEPQQQLCQKMKHMQVNGMFENWNSNQFVPFNCPQQDPQQYNVFTDLHGISQEFPYKSEMDSMPYTQNFISCNQPVLPQHSKCTELDYPMGSFEPSPYPTTSSLEDFVTCLQLPENQKHGLNPQSAIITPQTCYAGAVSMYQCQPEPQHTHVGQMQYNPVLPGQQAFLNKFQNGVLNETYPAELNNINNTQTTTHLQPLHHPSEARPFPDLTSSGFL

SEQ ID NO: 11546 - protein, 539 aa, Human
ILSCFWFPWQGLNCGVCGMVLSAVVCCDVPEEQYSSYLPPVDRTMLYFQVFGSAVYSSGSERHLTYIQKIFRMEIFGCFALTELSHGSNTKAIRTTAHYDPATEVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 11547 - protein, 297 aa, Human
YRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 11548 - protein, 510 aa, Human
PRGSEVARAPPPIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 11549 - protein, 694 aa, Human
TTKDMKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 11550 - protein, 354 aa, Human
SVMLGGSAGRLKMSSSGTLSNYYVDSLIGHEGDEVFAARFGPPGPGAQGRPAGVADGPAATAAEFASCSFAPRSAVFSASWSAVPSQPPAAAAMSGLYHPYVPPPPLAASASEPGRYVRSWMEPLPGFPGGAGGGGGGGGGGPGRGPSPGPSGPANGRHYGIKPETRAAPAPATAASTTSSSSTSLSSSSKRTECSVARESQGSSGPEFSCNSFLQEKAAAATGGTGPGAGIGAATGTGGSSEPSACSDHPIPGCSLKEEEKQHSQPQQQQLDPNNPAANWIHARSTRKKRCPYTKYQTLELEKEFLFNMYLTRDRRYEVARILNLTERQVKIWFQNRRMKMKKMSKEKCPKGD

SEQ ID NO: 11551 - protein, 431 aa, Human
RRTSGHVSLETLKKRQNGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEFQLLASALFKSGSDFTALGFSDVDHTYAQRTQLFDTLVNFFPDSMTPPKGNLVDLITL

SEQ ID NO: 11552 - protein, 351 aa, Human
SLSCARAPREPTQHALRAHWFPPAAAVQPSPHSGVAAAAGTWSSAFRGEHPLVSSGLLLGVREQSFRLLRSKAGTHMYLEHTSHCPHHDDDTAMDTPLPRPRPLLAVERTGQRPLWAPSLELPKPVMQPLPAGAFLEEVAEGTPAQTESEPKVLDPEEDLLCIAKTFSYLRESGWYWGSITASEARQHLQKMPEGTFLVRDSTHPSYLFTLSVKTTRGPTNVRIEYADSSFRLDSNCLSRPRILAFPDVVSLVQHYVASCTADTRSDSPDPAPTPALPMPKEDAPSDPALPAPPPATAVHLKLVQPFVRRSSARSLQHLCRLVINRLVADVDCLPLPRRMADYLRQYPFQL

SEQ ID NO: 11553 - protein, 396 aa, Human
KRQAGAASERPAGAMDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINQSMVVPQTPLHTARVLQEDKDHWDEVKEEMTSALATMRVDYDQVKIKDLKTSNNRLLNKRRKKQAGSSSASQGCNNQ

SEQ ID NO: 11554 - protein, 2560 aa, Human
ATRRNCPTSRGAPAGAKPQPQNRLIPNSLCRDQTRPNMGRKTSRVQQGPPRSPACSAHGERSWGLEFPPFRWLLGIAGRTHLAALPPFQVGTTWTPSAGLQSTQETLTGWVLAFEIFIPLVLFFILLGLRQKKPTISVKEAFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFGEAGIRMVAGVGAGFRVLGGLGAAPTLLIHSPGAEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQPPPPPPLQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMPPPPLQLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQGAGWGQDAPLSGQAPGQVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSTPSGASLCMSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 11555 - protein, 264 aa, Human
RMATPLPPPSPRHLRLLRLLLSGLVLGAALRGAAAGHPDVAACPGSLDCALKRRARCPPGAHACGPCLQPFQEDQQGLCVPRMRRPPGGGRPQPRLEDEIDFLAQELARKESGHSTPPLPKDRQRLPEPATLGFSARGQGLELGLPSTPGTPTPTPHTSLGSPVSSDPVHMSPLEPRGGQGDGLALVLILAFCVAGAAALSVASLCWCRLQREIRLTQKADYATAKAPGSPAAPRISPGDQRLAQSAEMYHYQHQRQQMLCLER

SEQ ID NO: 11556 - protein, 505 aa, Human
AMEAPLQTEMVELVPNGKHSEGLLPVITPMAGNQRVEDPARSCMEGKSFLQKSPSKEPHFTDFEGKTSFGMSVFNLSNAIMGSGILGLAYAMANTGIILFLFLLTAVALLSSYSIHLLLKSSGVVGIRAYEQLGYRAFGTPGKLAAALAITLQNIGAMSSYLYIIKSELPLVIQTFLNLEEKTSDWYMNGNYLVILVSVTIILPLALMRQLGYLGYSSGFSLSCMVFFLIAVIYKKFHVPCPLPPNFNNTTGNFSHVEIVKEKVQLQVEPEASAFCTPSYFTLNSQTAYTIPIMAFAFVCHPEVLPIYTELKDPSKKKMQHISNLSIAVMYIMYFLAALFGYLTFYNGVESELLHTYSKVDPFDVLILCVRVAVLTAVTLTVPIVLFPVRRAIQQMLFPNQEFSWLRHVLIAVGLLTCINLLVIFAPNILGIFGVIGATSAPFLIFIFPAIFYFRIMPTEKEPARSTPKILALCFAMLGFLLMTMSLSFIIIDWASGTSRHGGNH

SEQ ID NO: 11557 - protein, 621 aa, Human
PLSAGEDMTTLDSNNNTGGVITYIGSSGSSPSRTSPESLYSDNSNGSFQSLTQGCPTYFPPSPTGSLTQDPARSFGSIPPSLSDDGSPSSSSSSSSSSSSFYNGSPPGSLQVAMEDSSRVSPSKSTSNITKLNGMVLLCKVCGDVASGFHYGVHACEGCKGFFRRSIQQNIQYKRCLKNENCSIVRINRNRCQQCRFKKCLSVGMSRDAVRFGRIPKREKQRMLAEMQSAMNLANNQLSSQCPLETSPTQHPTPGPMGPSPPPAPVPSPLVGFSQFPQQLTPPRSPSPEPTVEDVISQVARAHREIFTYAHDKLGSSPGNFNANHASGSPPATTPHRWENQGCPPAPNDNNTLAAQRHNEALNGLRQAPSSYPPTWPPGPAHHSCHQSNSNGHRLCPTHVYAAPEGKAPANSPRQGNSKNVLLACPMNMYPHGRSGRTVQEIWEDFSMSFTPAVREVVEFAKHIPGFRDLSQHDQVTLLKAGTFEVLMVRFASLFNVKDQTVMFLSRTTYSLQELGAMGMGDLLSAMFDFSEKLNSLALTEEELGLFTAVVLVSADRSGMENSASVEQLQETLLRALRALVLKNRPLETSRFTKLLLKLPDLRTLNNMHSEKLLSFRVDAQ

SEQ ID NO: 11558 - protein, 221 aa, Human
DASGGRWTVMAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 11559 - protein, 479 aa, Human
LPRARPPMAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 11560 - protein, 395 aa, Human
LPTRVLPAEGWWWERSGSGGAEPGRGPCGGRAAAGPADGGMGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 11561 - protein, 608 aa, Human; identical to SEQ ID NO: 8981

SEQ ID NO: 11562 - protein, 544 aa, Human
MSDGLDNEEKPPAPPLRMNSNNRDSSALNHSSKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 11563 - protein, 974 aa, Human
TMAQLYYKKVNYSPYRDRIPLQIVRAETELSAEEKAFLNAVEKGDYATVKQALQEAEIYYNVNINCMDPLGRSALLIAIENENLEIMELLLNHSVYVGDALLYAIRKEVVGAVELLLSYRRPSGEKQVPTLMMDTQFSEFTPDITPIMLAAHTNNYEIIKLLVQKRVTIPRPHQIRCNCVECVSSSEVDSLRHSRSRLNIYKALASPSLIALSSEDPILTAFRLGWELKELSKVENEFKAEYEELSQQCKLFAKDLLDQARSSRELEIILNHRDDHSEELDPQKYHDLAKLKVAIKYHQKEFVAQPNCQQLLATLWYDGFPGWRRKHWVVKLLTCMTIGFLFPMLSIAYLISPRSNLGLFIKKPFIKFICHTASYLTFLFMLLLASQHIVRTDLHVQGPPPTVVEWMILPWVLGFIWGEIKEMWDGGFTEYIHDWWNLMDFAMNSLYLATISLKIVAYVKYNGSRPREEWEMWHPTLIAEALFAISNILSSLRLISLFTANSHLGPLQISLGRMLLDILKFLFIYCLVLLAFANGLNQLYFYYETRAIDEPNNCKGIRCEKQNNAFSTLFETLQSLFWSVFGLLNLYVTNVKARHEFTEFVGATMFGTYNVISLVVLLNMLIAMMNNSYQLIADHADIEWKFARTKLWMSYFDEGGTLPPPFNIIPSPKSFLYLGNWFNNTFCPKRDPDGRRRRRNLRSFTERNADSLIQNQHYQEVIRNLVKRYVAAMIRNSKTHEGLTEENFKELKQDISSFRYEVLDLLGNRKHPRSFSTSSTELSQRDDNNDGSGGARAKSKSVSFNLGCKKKTCHGPPLIRTMPRSSGAQGKSKAESSSKRSFMGPSLKKLGLLFSKFNGHMSEPSSEPMYTISDGIVQQHCMWQDIRYSQMEKGKAEACSQSEINLSEVELGEVQGAAQSSECPLACSSSLHCASSICSSNSKLLDSSEDVFETWGEACDLLMHKWGDGQEEQVTTRL

SEQ ID NO: 11564 - protein, 272 aa, Human
TPGIFTEQSMITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 11565 - protein, 256 aa, Human
LKHQSVMALRAGLVLGFHTLMTLLSPQEAGATKADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAMETLVCALGLAIGLVGFLVGTVLIIMGTYVSSVPR

SEQ ID NO: 11566 - protein, 234 aa, Human
GNQCPRRRGERCLAGMLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 11567 - protein, 393 aa, Human
SPPFALTDPLGVRRTMQLRLFRRLLLAALLLVIVWTLFGPSGLGEELLSLSLASLLPAPASPGPPLALPRLLIPNQEACSGPGAPPFLLILVCTAPENLNQRNAIRASWGGLREARGLRVQTLFLLGEPNAQHPVWGSQGSDLASESAAQGDILQAAFQDSYRNLTLKTLSGLNWAEKHCPMARYVLKTDDDVYVNVPELVSELVLRGGRWGQWERSTEPQREAEQEGGQVLHSEEVPLLYLGRVHWRVNPSRTPGGRHRVSEEQWPHTWGPFPPYASGTGYVLSASAVQLILKVASRAPLLPLEDVFVGVSARRGGLAPTQCVKLAGATHYPLDRCCYGKFLLTSHRLDPWKMQEAWKLVGGSDGERTAPFCSWFQGVLGILRCRAIAWLQS

SEQ ID NO: 11568 - protein, 277 aa, Human
RVLLFLTAALFILPSFSSSMMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 11569 - protein, 742 aa, Human
SPMATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 11570 - protein, 475 aa, Human
CPCPAPGGPSCHRPPQDAMAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTRAGPWGRGLTSPGEAPEAGARAPEEEAEGESGGAGATLSSAQSARAPGAEGAGSSAEGTAAAPSGCLLPSTLLPAPQGPLGTVDPQTGHPWNFTLVSPQTSLKVPPTR

SEQ ID NO: 11571 - protein, 782 aa, Human
FLHSAMLPRPLRLLLDTSPPGGVVLSSFRSRDPEEGGGPGGLVVGGGQEEEEEEEEEAPVSVWDEEEDGAVFTVTSRQYRPLDPLVPMPPPRSSRRLRAGTLEALVRHLLDTRTSGTDVSFMSAFLATHRAFTSTPALLGLMADRLEALESHPTDELERTTEVAISVLSTWLASHPEDFGSEAKGQLDRLESFLLQTGYAAGKGVGGGSADLIRNLRSRVDPQAPDLPKPLALPGDPPADPTDVLVFLADHLAEQLTLLDAELFLNLIPSQCLGGLWGHRDRPGHSHLCPSVRATVTQFNKVAGAVVSSVLGATSTGEGPGEVTIRPLRPPQRARLLEKWIRVAEECRLLRNFSSVYAVVSALQSSPIHRLRAAWGEATRDSLRVFSSLCQIFSEEDNYSQSRELLVQEVKLQSPLEPHSKKAPRSGSRGGGVVPYLGTFLKDLVMLDAASKDELENGYINFDKRRKEFAVLSELRRLQNECRGYNLQPDHDIQRWLQGLRPLTEAQSHRVSCEVEPPGSSDPPAPRVLRPTLVISQWTEVLGSVGVPTPLVSCDRPSTGGDEAPTTPAPLLTRLAQHMKWPSVSSLDSALESSPSLHSPADPSHLSPPASSPRPSRGHRRSASCGSPLSGGAEEASGGTGYGGEGSGPGASDCRIIRVQMELGEDGSVYKSILVTSQDKAPSVISRVLKKNNRDSAVASEYELVQLLPGERELTIPASANVFYAMDGASHDFLLRQRRRSSTATPGVTSGPSASGTPPSEGGGGSFPRIKATGRKIARALF

SEQ ID NO: 11572 - protein, 577 aa, Human
FDPIQARVFLSGASSCSANPPINPWESLGPLRYPYSQPGIMSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRSLSRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 11573 - protein, 730 aa, Human
QLPEVRLRGMAAAATMAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTNYQIPQTALLKYRFFYQFLLGNERATAKEIRDEYVETLSKIYLSYYRSYLGRLMKVQYEEVAEKDDLMGVEDTAKKDILPSLRSRNTIFTLGTRGSVISPTELEAPILVPHTAQRGEQRYPFEALFRSQHYALLDNSCREYLFICEFFVVSGPAAHDLFHAVMGRTLSMTLKHLDSYLADCYDAIAVFLCIHIVLRFRNIAAKRDVPALDRYWEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 11574 - protein, 129 aa, Human
MAELIQKKLQGEVEKYQQLQKDLSKSMSGRQKLEAQLTENNIVKEELALLDGSNVVFKLLGPVLVKQELGEARATVGKRLDYITAEIKRYESQLRDLERQSEQQRETLAQLQQEFQRAQAAKAGAPGKA

SEQ ID NO: 11575 - protein, 684 aa, Human
HSPTAGPTMAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 11576 - protein, 382 aa, Human
CAWCVASGEEMAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 11577 - protein, 366 aa, Human
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 11578 - protein, 327 aa, Human
PPETHSALALTCLLIGGWLLRIMTSRTPLLVTACLYYSYCNSRHLQQGVRKSKRPVFSHCQVPETQKTDTRHLSGARAGVCPCCHPDGLLATMRDLLQYIACFFAFFSAGFLIVATWTDCWMVNADDSLEVSTKCRGLWWECVTNAFDGIRTCDEYDSILAEHPLKLVVTRALMITADILAGFGFLTLLLGLDCVKFLPDEPYIKVRICFVAGATLLIAGTPGIIGSVWYAVDVYVERSTLVLHNIFLGIQYKFGWSCWLGMAGSLGCFLAGAVLTCCLYLFKDVGPERNYPYSLRKAYSAAGVSMAKSYSAPRTETAKMYAVDTRV

SEQ ID NO: 11579 - protein, 247 aa, Human
LPPRGPATFGSPGCPPANSPPSAPATPEPARAPERVMANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 11580 - protein, 338 aa, Human
RCCLRHLLRRRAPLGVPRPTMPNIVLFSGSSHQDLSQRVADRLGLELGKVVTKKFSNQETSVEIGESVRGEDVYIIQSGCGEINDNLMELLIMINACKIASSSRVTAVIPCFPYARQDKKDKSRAPISAKLVANMLSVAGADHIITMDLHASQIQGFFDIPVDNLYAEPAVLQWIRENIAEWKNCIIVSPDAGGAKRVTSIADRLNVEFALIHKERKKANEVDRMVLVGDVKDRVAILVDDMADTCGTICHAADKLLSAGATKVYAILTHGIFSGPAISRINNAAFEAVVVTNTIPQEDKMKHCTKIQVIDISMILAEAIRRTHNGESVSYLFSHVPL

SEQ ID NO: 11581 - protein, 364 aa, Human
GLGWELCCGKQPGLHLASMALLKVKFDQKKRVKLAQGLWLMNWFSVLAGIIIFSLGLFLKIELRKRSDVMNNSESHFVPNSLIGMGVLSCVFNSLAGKICYDALDPAKYARWKPWLKPYLAICVLFNIILFLVALCCFLLRGSLENTLGQGLKNGMKYYRDTDTPGRCFMKKTIDMLQIEFKCCGNNGFRDWFEIQWISNRYLDFSSKEVKDRIKSNVDGRYLVDGVPFSCCNPSSPRPCIQYQITNNSAHYSYDHQTEELNLWVRGCRAALLSYYSSLMNSMGVVTLLIWLFEVTITIGLRYLQTSLDGVSNPEESESESEGWLLEKSVPETWKAFLESVKKLGKGNQVEAEGAGAGQAPEAG

SEQ ID NO: 11582 - protein, 621 aa, Human
MSPVFPMLTVLTMFYYICLRRRARTATRGEMMNTHRAIESNSQTSPLNAEVVQYAKEVVDFSSHYGSENSMSYTMWNLAGVPNVFPSSGDFTQTAVFRTYGTWWDQCPSASLPFKRTPPNFQSQDYVELTFEQQVYPTAVHVLETYHPGAVIRILACSANPYSPNPPAEVRWEILWSERPTKVNASQARQFKPCIKQINFPTNLIRLEVNSSLLEYYTELDAVVLHGVKDKPVLSLKTSLIDMNDIEDDAYAEKDGCGMDSLNKKFSSAVLGEGPNNGYFDKLPYELIQLILNHLTLPDLCRLAQTCKLLSQHCCDPLQYIHLNLQPYWAKLDDTSLEFLQSRCTLVQWLNLSWTGNRGFISVAGFSRFLKVCGSELVRLELSCSHFLNETCLEVISEMCPNLQALNLSSCDKLPPQAFNHIAKLCSLKRLVLYRTKVEQTALLSILNFCSELQHLSLGSCVMIEDYDVIASMIGAKCKKLRTLDLWRCKNITENGIAELASGCPLLEELDLGWCPTLQSSTGCFTRLAHQLPNLQKLFLTANRSVCDTDIDELACNCTRLQQLDILGTRMVSPASLRKLLESCKDLSLLDVSFCSQIDNRAVLELNASFPKVFIKKSFTQ

SEQ ID NO: 11583 - protein, 239 aa, Human
SAGEGQFSVRRKRAADGTAPARALPQQLQLAASLPANLSNFCQGSEMPTTSRPALDVKGGTSPAKEDANQEMSSVAYSNLAVKDRKAVAILHYPGVASNGTKASGAPTSSSGSPIGSPTTTPPTKPPSFNLHPAPHLLASMQLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 11584 - protein, 267 aa, Human
TLVTYLSAANQHLEVGLLSAKGERGLVGDAPCAPMNVHGDGEAGLQVRTSQSRNPGGRRPGRQSRARIPKMAAVKDSCGKGEMATGNGRRLHLGIPEAVFVEDVDSFMKQPGNETADTVLKKLDEQYQKYKFMELNLAQKKRRLKGQIPEIKQTLEILKYMQKKKESTNSMETRFLLADNLYCKASVPPTDKVCLWLGANVMLEYDIDEAQALLEKNLSTATKNLDSLEEDLDFLRDQFTTTEVNMARVYNWDVKRRNKDDSTKNKA

SEQ ID NO: 11585 - protein, 330 aa, Human
LAVAGDSPAGHCLERLERLPLQTSVRLQPLSSDGHDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 11586 - protein, 348 aa, Human
RGGAELGRPWRNSASAAGGAGSGAAGSRATGFLLHRCAHRGRAPCRERGFSVRTLAPSPGKMKDRLAELLDLSKQYDQQFPDGDDEFDSPHEDIVFETDHILESLYRDIRDIQDENQLLVADVKRLGKQNARFLTSMRRLSSIKRDTNSIAKAIKARGEVIHCKLRAMKELSEAAEAQHGPHSAVARISRAQYNALTLTFQRAMHDYNQAEMKQRDNCKIRIQRQLEIMGKEVSGDQIEDMFEQGKWDVFSENLLADVKGARAALNEIESRHRELLRLESRIRDVHELFLQMAVLVEKQADTLNVIELNVQKTVDYTGQAKAQVRKAVQYEEKNPCRTLCCFCCPCLK

SEQ ID NO: 11587 - protein, 290 aa, Human
DKDQTKMTTAHFYCQYCTASLLGKKYVLKDDSPYCVTCYDRVFSNYCEECKKPIESDSKDLCYKDRHWHEGCFKCTKCNHSLVEKPFAAKDERLLCTECYSNECSSKCFHCKRTIMPGSRKMEFKGNYWHETCFVCENCRQPIGTKPLISKESGNYCVPCFEKEFAHYCNFCKKVITSGGITFCDQLWHKECFLCSGCRKDLCEEQFMSRDDYPFCVDCYNHLYANKCVACSKPISGLTGAKFICFQDSQWHSECFNCGKCSVSLVGKGFLTQNKEIFCQKCGSGMDTDI

SEQ ID NO: 11588 - protein, 178 aa, Human
AVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 11589 - protein, 518 aa, Human
LPVRPPASSAMLPTQAGAAAALGRGSALGGSLNRTPTGRPGGGGGTRGANGGRVPGNGAGLGPGRLEREAAAAAATTPAPTAGALYSGSEGDSESGEEEELGAERRGLKRSLSEMEIGMVVGGPEASAAATGGYGPVSGAVSGAKPGKKTRGRVKIKMEFIDNKLRRYTTFSKRKTGIMKKAYELSTLTGTQVLLLVASETGHVYTFATRKLQPMITSETGKALIQTCLNSPDSPPRSDPTTDQRMSATGFEETDLTYQVSESDSSGETKDTLKPAFTVTNLPGTTSTIQTAPSTSTTMQVSSGPSFPITNYLAPVSASVSPSAVSSANGTVLKSTGSGPVSSGGLMQLPTSFTLMPGGAVAQQVPVQAIQVHQAPQQASPSRDSSTDLTQTSSSGTVTLPATIMTSSVPTTVGGHMMYPSPHAVMYAPTSGLGDGSLTVLNAFSQAPSTMQVSHSQVQEPGGVPQVFLTASSGTVQIPVSAVQLHQMAVIGQQAGSSSNLTELQVVNLDTAHSTKSE

SEQ ID NO: 11590 - protein, 176 aa, Human
LFRKLNEQSPTRCTLEAGAMTFHYIIEQGVCDLVLCEAAFPKKLAFAYLEDLHSEFDEQHGKKVPTVSRPYSFIEFDTFIQKTKKLYIDSCARRNLGSINTELQDVQRIMVANIEEVLQRGEALSALDSKANNLSSLSKKYRQDAKYLNMHSTYAKLAAVAVFFIMLIVYVRFWWL

SEQ ID NO: 11591 - protein, 249 aa, Human
LSGDRRVQSLTSHTAEMDNQGVIYSDLNLPPNPKRQQRKPKGNKSSILATEQEITYAELNLQKASQDFQGNDKTYHCKDLPSAPEKLIVGILGIICLILMASVVTIVVIPSTLIQRHNNSSLNTRTQKARHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSMIYHCKHKL

SEQ ID NO: 11592 - protein, 249 aa, Human; identical to SEQ ID NO: 11591

SEQ ID NO: 11593 - protein, 91 aa, Human
RHNPHENMPLAKDLLHPSPEQEKRKHKKKRLVQSPNSYFMDVKCPGCYKITTVFSHAQTVVLCVGCSTVLCQPTGGKARLTEGYSFTRKQH

SEQ ID NO: 11594 - protein, 361 aa, Human
RKERYAIYCANQNMHMARLAVSLKFPRMQLSFLRQIELLDFKGEDLFEDGGIIRRTKRKGEGYSNPNEGATVEIHLEGRCGGRMFDCRDVAFTVGEGEDHDIPIGIDKALEKMQREEQCILYLGPRYGFGEAGKPKFGIEPNAELIYEVTLKSFEKAKESWEMDTKEKLEQAAIVKEKGTVYFKGGKYMQAVIQYGKIVSWLEMEYGLSEKESKASESFLLAAFLNLAMCYLKLREYTKAVECCDKALGLDSANEKGLYRRGEAQLLMNEFESAKGDFEKVLEVNPQNKAARLQISMCQKKAKEHNERDRRIYANMFKKFAEQDAKEEANKAMGKKTSEGVTNEKGTDSQAMEEEKPEGHV

SEQ ID NO: 11595 - protein, 631 aa, Human
MALRKELLKSIWYAFTALDVEKSGKVSKSQLKVLSHNLYTVLHIPHDPVALEEHFRDDDDGPVSSQGYMPYLNKYILDKVEEGAFVKEHFDELCWTLTAKKNYRADSNGNSMLSNQDAFRLWCLFNFLSEDKYPLIMVPDEVEYLLKKVLSSMSLEVSLGELEELLAQEAQVAQTTGGLSVWQFLELFNSGRCLRGVGRDTLSMAIHEVYQELIQDVLKQGYLWKRGHLRRNWAERWFQLQPSCLCYFGSEECKEKRGIIPLDAHCCVEVLPDRDGKRCMFCVKTATRTYEMSASDTRQRQEWTAAIQMAIRLQAEGKTSLHKDLKQKRREQREQRERRRAAKEEELLRLQQLQEEKERKLQELELLQEAQRQAERLLQEEEERRRSQHRELQQALEGQLREAEQARASMQAEMELKEEEAARQRQRIKELEEMQQRLQEALQLEVKARRDEESVRIAQTRLLEEEEEKLKQLMQLKEEQERYIERAQQEKEELQQEMAQQSRSLQQAQQQLEEVRQNRQRADEDVEAAQRKLRQASTNVKHWNVQMNRLMHPIEPGDKRPVTSSSFSGFQPPLLAHRDSSLKRLTRWGSQGNRTPSPNSNEQQKSLNGGDEAPAPASTPQEDKLDPAPEN

SEQ ID NO: 11596 - protein, 382 aa, Human
DEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVVEDWKFIAQVLDRMFLWTFLFVSIVGSLGLFVPVIYKWANILIPVHIGNANK

SEQ ID NO: 11597 - protein, 500 aa, Human
CDAAAAADLGINGKSFGRSGRILRSLRDGGGGAVGSRDRPRRCQSYDWACRCGAEGRSAMEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 11598 - protein, 390 aa, Human
GREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 11599 - protein, 300 aa, Human
FGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQM

SEQ ID NO: 11600 - protein, 174 aa, Human
RGQLYCVHLSTLRVLLLRGSPRRGPPRPSPSARTVTSSALWSTSWATSSASGTNTLGQTGTATFPSFVRTSSQSLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEK

SEQ ID NO: 11601 - protein, 174 aa, Human; identical to SEQ ID NO: 11600

SEQ ID NO: 11602 - protein, 174 aa, Human; identical to SEQ ID NO: 11600

SEQ ID NO: 11603 - protein, 321 aa, Human
STRAHGPSSPRGETRASTSPGCSPAPAPAMEELTAFVSKSFDQKSKDGNGGGGGGGGKKDSITYREVLESGLARSRELGTSDSSLQDITEGGGHCPVHLFKDHVDNDKEKLKEFGTARVAEGIYECKEKREDVKSEDEDGQTKLKQRRSRTNFTLEQLNELERLFDETHYPDAFMREELSQRLGLSEARVQVWFQNRRAKCRKQENQMHKGVILGTANHLDACRVAPYVNMGALRMPFQQVQAQLQLEGVAHAHPHLHPHLAAHAPYLMFPPPPFGLPIASLAESASAAAVVAAAAKSNSKNSSIADLRLKARKHAEALGL

SEQ ID NO: 11604 - protein, 321 aa, Human; identical to SEQ ID NO: 11603

SEQ ID NO: 11605 - protein, 504 aa, Human
CCGAKFEASGGAGARLRSRTCSSFFGCLGPLSPAIMPIRALCTICSDFFDHSRDVAAIHCGHTFHLQCLIQWFETAPSRTCPQCRIQVGKRTIINKLFFDLAQEEENVLDAEFLKNELDNVRAQLSQKDKEKRDSQVIIDTLRDTLEERNATVVSLQQALGKAEMLCSTLKKQMKYLEQQQDETKQAQEEARRLRSKMKTMEQIELLLQSQRPEVEEMIRDMGVGQSAVEQLAVYCVSLKKEYENLKEARKASGEVADKLRKDLFSSRSKLQTVYSELDQAKLELKSAQKDLQSADKEIMSLKKKLTMLQETLNLPPVASETVDRLVLESPAPVEVNLKLRRPSFRDDIDLNATFDVDTPPARPSSSQHGYYEKLCLEKSHSPIQDVPKKICKGPRKESQLSLGGQSCAGEPDEELVGAFPIFVRNAILGQKQPKRPRSESSCSKDVVRTGFDGLGGRTKFIQPTDTVMIRPLPVKPKTKVKQRVRVKTVPSLFQAKLDTFLWS

SEQ ID NO: 11606 - protein, 211 aa, Human
AATSESACRPCAAEPAARMPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 11607 - protein, 737 aa, Human
APAARHPPPATMNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 11608 - protein, 390 aa, Human
PAGGCSGPGRRVCGPGAEAATRDAARTLRPAQPGPAMAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQFSPGAPGGSGSQPNQKLGHPEALSAGTGSPQPPSFTYAQQREKPRVQEKQHPVPPPAQNQNQALLVSFLHLEMQGREVCFLAAQPGLCVRTPGMKALANSAGPFCPFQADCGKPLSIEADDNGCFPLDGHVLCRKCHTARAQT

SEQ ID NO: 11609 - protein, 715 aa, Human
SEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 11610 - protein, 715 aa, Human; identical to SEQ ID NO: 11609

SEQ ID NO: 11611 - protein, 1668 aa, Human
FYLLGARRVILLPPLLPPPPGWLSRAGSADSLSQPSPQGGGIGDTGKGKHWGGGAGESQIPREAMEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGWPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPHWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFALLGMQLFGGRYDFEDTEVRRSNFDNFPQALISVFQVLTGEDWTSMMYNGIMAYGGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVVQCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGDPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRHACATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRCPL

SEQ ID NO: 11612 - protein, 1390 aa, Human
QISRQQEPRGRCGAFRSSVRQNGWALPAVGMSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 11613 - protein, 443 aa, Human
QYANIRFRFMGIENIHVMRSSLQKLLEVCELKTPTMSEFLSGLESSGWLRHIKAIMDAGIFITKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLRVYEKTHSVWPFLVQRKPDFRNPLYKGFTMYGVLNPSTVPYNIQFWCGMYNRFDKGLQPKQSMLESLLEIKKQRAMLETDVHELEKKLKVRDEPPEEICTCSQLGNILSQHLGSPLTNPLGFMGINGDLNTLMENGTLSREGGLRAQMDQVKSQGADLHHNCCEIVGSLRAINISGDVGISEAMGISGDMCTFEATGFSKDLGICGAMDISEATGISGNLGISEARGFSGDMGILGDTGISKASTKEADYSKHQ

SEQ ID NO: 11614 - protein, 607 aa, Human
TGRGPAGSVGWDVKWQLLSDKATMCYTHALFLQRQLRPRRSEAGRFRPRALRPDVSVARSAVTKSAGLYWRGPDGRGLCGAVLGDTRRCPVLAMADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 11615 - protein, 240 aa, Human
SRKEVERGGIRKREKERREGRKKARDETTMLCCMRRTKQVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIGE

SEQ ID NO: 11616 - protein, 335 aa, Human
SANHMNSSLLSLYRKGNPDSVSNTPEMEQRETTSSTPRISSKTGSIPLKTPAKDSEGGWFIDKTPSVKKDSFFLDLSCEKSNPKKPITEIQSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAIL

SEQ ID NO: 11617 - protein, 348 aa, Human
ETPLCPVMPKRKVTFQGVGDEEDEDEIIVPKKKLVDPVAGSGGPGSRFKGKHSLDSDEEEDDDDGGSSKYDILASEDVEGQEAATLPSEGGVRITPFNLQEEMEEGHFDADGNYFLNRDAQIRDSWLDNIDWVKIRERPPGQRQASDSEEEDSLGQTSMSAQALLEGLLELLLPRETVAGALRRLGARGGGKGRKGPGQPSSPQRLDRLSGLADQMVARGNLGVYQETRERLAMRLKGLGCQTLGPHNPTPPPSLDMFAEELAEEELETPTPTQRGEAESRGDGLVDVMWEYKWENTGDAELYGPFTSAQMQTWVSEGYFPDGVYCRKLDPPGGQFYNSKRIDFDLYT

SEQ ID NO: 11618 - protein, 1065 aa, Human
TALPSGPPAPPSPLPARGRGRGRRCLARQRRWPRLLLLLLPPLPRLLARARAGGLSLCSGAEPAVPPPDPEAAAPPGAGPPPPAPPPQELEPSGELGPRAQARTMHGHRAPGGAGPSEPEHPATNPPGAAPPACADSDPGASEPGLLARRGSGSALGGPLDPQFVGPSDTSLGAAPGHRVLPCGPSPQHHRALRFSYHLEGSQPRPGLHQGNRILVKSLSLDPGQSLEPHPEGPQRLRSDPGPPTETPSQRPSPLKRAPGPKPQVPPKPSYLQMPRMPPPLEPIPPPPSRPLPADPRVAKGLAPRAEASPSSAAVSSLIEKFEREPVIVASDRPVPGPSPGPPEPVMLPQPTSQPPVPQLPEGEASRCLFLLAPGPRDGEKVPNRDSGIDSISSPSNSEETCFVSDDGPPSHSLCPGPPALASVPVALADPHRPGSQEVDSDLEEEDDEEEEEEKDREIPVPLMERQESVELTVQQKVFHIANELLQTEKAYVSRLHLLDQVFCARLLEEARNRSSFPADVVHGIFSNICSIYCFHQQFLLPELEKRMEEWDRYPRIGDILQKLAPFLKMYGEYVKNFDRAVELVNTWTERSTQFKVIIHEVQKEEACGNLTLQHHMLEPVQRIPRYELLLKDYLLKLPHGSPDSKDAQKSLELIATAAEHSNAAIRKMERMHKLLKVYELLGGEEDIVSPTKELIKEGHILKLSAKNGTTQDRYLILFNDRLLYCVPRLRLLGQKFSVRARIDVDGMELKESSNLNLPRTFLVSGKQRSLELQARTEEEKKDWVQAINSTLLKHEQTLETFKLLNSTNREDEDTPPNSPNVDLGKRAPTPIREKEVTMCMRCQEPFNSITKRRHHCKACGHVVCGKCSEFRARLVYDNNRSNRVCTDCYVALHGVPGSSPACSQHTPQRRRSILEKQASVAAENSVICSFLHYMEKGGKGWHKAWFVVPENEPLVLYIYGAPQDVKAQRSLPLIGFEVGPPEAGERPDRRHVFKITQSHLSWYFSPETEELQRRWMAVLGRAGRGDTFCPGPTLSEDREMEEAPVAALGATAEPPESPQTRDKT

SEQ ID NO: 11619 - protein, 374 aa, Human
QVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 11620 - protein, 215 aa, Human
PAKTYRFFSLWQRGRPDRSSAPIGNSGLPCPDLEPLGGLQSKCRLCAPTEARGLWSRSLCSDRCDTWRSMLAGAGRPGLPQGRHLCWLLCAFTLKLCQAEAPVQEEKLSASTSNLPCWLVEEFVVAEECSPCSNFRAKTTPECGPTGYVEKITCSSSKRNEFKSCRSALMEQRLFWKFEGAVVCVALIFACLVIIRQRQLDRKALEKVRKQIESI

SEQ ID NO: 11621 - protein, 217 aa, Human
SAGQKDNRPGDKFQLTFPLRTNYMYAKVKKSLPEMYAFTVCMWLKSSATPGVGTPFSYAVPGQANELVLIEWGNNPMEILINDKVAKLPFVINDGKWHHICVTWTTRDGVWEAYQDGTQGGSGENLAPYHPIKPQGVLVLGQEQDTLGGGFDATQAFVGELAHFNIWDRKLTPGEVYNLATCSTKALSGNVIAWAESHIEIYGGATKWTFEACRQIN

SEQ ID NO: 11622 - protein, 262 aa, Human
AAAAADSGSHCHAPPTTARRAFPIPFGSKSNMATLKDQLIYNLLKEEQTPQNKITVVGVGAVGMACAISILMKDLADELALVDVIEDKLKGEMMDLQHGSLFLRTPKIVSGKVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDLQF

SEQ ID NO: 11623 - protein, 406 aa, Human
GSAAARYLSATWRNWISLPPAGLPATAGLRHSGSLMAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 11624 - protein, 436 aa, Human
APGDRRGESRARESAACARMEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 11625 - protein, 1854 aa, Human
ARCCAPSQNPLRPFLPAAIPNFAQSRWTLSCRRDRWTDLGTDRGPGGKQAKDPQAEMELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 11626 - protein, 588 aa, Human
QVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGK

SEQ ID NO: 11627 - protein, 363 aa, Human
ATAPATPTAPLRAGWAAGSRLQRWMWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 11628 - protein, 238 aa, Human
IRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDREP

SEQ ID NO: 11629 - protein, 375 aa, Human
ARSYRQLTMEANGLGPQGFPELKNDTFLRAAWGEETDYTPVWCMRQAGRYLPEFRETRAAQDFFSTCRSPEACCELTLQPLRRFPLDAAIIFSDILVVPQALGMEVTMVPGKGPSFPEPLREEQDLERLRDPEVVASELGYVFQAITLTRQRLAGRVPLIGFAGAPWTLMTYMVEGGGSSTMAQAKRWLYQRPQASHQLLRILTDALVPYLVGQVVAGAQALQLFESHAGHLGPQLFNKFALPYIRDVAKQVKARLREAGLAPVPMIIFAKDGHFALEELAQAGYEVVGLDWTVAPKKARECVGKTVTLQGNLDPCALYASEEEIGQLVKQMLDDFGPHRYIANLGHGLYPDMDPEHVGAFVDAVHKHSRLLRQN

SEQ ID NO: 11630 - protein, 474 aa, Human [sequence omitted]

SEQ ID NO: 11631 - protein, 134 aa, Human
MTRDQNGTWEMESNENFEGYMKALDIDFATRKIAVRLTQTKVIDQDGDNFKTKTTSTFRNYDVDFTVGVEFDEYTKSLDNRHVKALVTWEGDVLVCVQKGEKENRGWKQWIEGDKLYLELTCGDQVCRQVFKKK

SEQ ID NO: 11632 - protein, 581 aa, Human
CGASPARMATLVVNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHRRVPLADKPHEKTMCSQHQVHAIEFVCLEEGCQTSPLMCCVCKEYGKHQGHKHSVLEPEANQIRASILDMAHCIRTFTEEISDYSRKLVGIVQHIEGGEQIVEDGIGMAHTEHVPGTAENARSCIRAYFYDLHETLCRQEEMALSVVDAHVREKLIWLRQQQEDMTILLSEVSAACLHCEKTLQQDDCRVVLAKQEITRLLETLQKQQQQFTEVADHIQLDASIPVTFTKDNRVHIGPKMEIRVVTLGLDGAGKTTILFKLKQDEFMQPIPTIGFNVETVEYKNLKFTIWDVGGKHKLRPLWKHYYLNTQAVVFVVDSSHRDRISEAHSELAKLLTEKELRDALLLIFANKQDVAGALSVEEITELLSLHKLCCGRSWYIQGCDARSGMGLYEGLDWLSRQLVAAGVLDVA

SEQ ID NO: 11633 - protein, 483 aa, Human
MAVAASAAAAGPAGAGGGRAQRSGLLEVLVRDRWHKVLVNLSEDALVLSSEEGAAAYNGIGTATNGSFCRGAGAGHPGAGGAQPPDSPAGVRTAFTDLPEQVPESISNQKRGVKVLKQELGGLGISIKGGKENKMPILISKIFKGLAADQTQALYVGDAILSVNGADLRDATHDEAVQALKRAGKEVLLEVKYMREATPYVKKGSPVSEIGWETPPPESPRLGGSTSDPPSSQSFSFHRDRKSIPLKMCYVTRSMALADPENRQLEIHSPDAKHTVILRSKDSATAQAWFSAIHSNVNDLLTRVIAEVREQLGKTGIAGSREIRHLGWLAEKVPGESKKQWKPALVVLTEKDLLIYDSMPRRKEAWFSPVHTYPLLATRLVHSGPGKGSPQAGVDLSFATRTGTRQGIETHLFRAETSRDLSHWTRSIVQGCHNSAELIAEISTACTYKNQECRLTIHYENGFSITTEPQGGCLSQDHHTVSL

SEQ ID NO: 11634 - protein, 205 aa, Human
LRRGRSRETNEEPPPPTVQVQGPGPQREEKQKTKMAKFVIRPATAADCSDILRLIKELAKYEYMEEQVILTEKDLLEDGFGEHPFYHCLVAEVPKEHWTPEGHSIVGFAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 11635 - protein, 250 aa, Human
RFGSWGGGKSGRAGGAGARRGGKELRVAAERPRSQRRPTQPSRRRRRAPMAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 11636 - protein, 120 aa, Human
ALDCQTATQLLKLAHKYRPETKQEKKQRLLAWAEKKAAGKRDVPTKRPPVLRAGVNIVTTLVENKKAQLVVIADDVDPIELVVFLPALCRKMGVPYCIIKGKARLGRLVHRKTCTTVTFT

SEQ ID NO: 11637 - protein, 409 aa, Human
GMEEGGREPEAAERTAHQGSGSSDRVKLRWLPGSPAGMHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKGLVTEGSGLQPGLLDVLLKPPSKKSESLRPPHCKDT

SEQ ID NO: 11638 - protein, 290 aa, Human
RTGAKSRERGRKGTRARPGRRAARPWGFCGPSGARLASSHGVRSVGDPGPGAVPGGLGGSDPGVRAAHVAGDRLPGPQHRDGADHLEGAVDVVRGAEHRAHAVQSVRLGAGSEHRGAGGAGAHRERRAAGVRCALRDPGGRAVHHLRGPGPGQGACGPHGRRALPVLRAAGARATLLVRQHCRPRVLRPVCARVAEVRAGRSAVHRLGGHRAAHGRRLPLVLRRLGLHRPSRPQLPREVLSAAAAHGHRRLRQEELRLRALGTAGPLLPATPARRWISLGSPAWTAASAG

SEQ ID NO: 11639 - protein, 215 aa, Human
ARPEAARVAMTASVLRSISLALRPTSGLLGTWQTQLRETHQRASLLSFWELIPMRSEPLRKKKKVDPKKDQEAKERLKRKIRKLEKATQELIPIEDFITPLKFLDKARERPQVELTFEETERRALLLKKWSLYKQQERKMERDTIRAMLEAQQEALEELQLESPKLHAEAIKRDPNLFPFEKEGPHYTPPIPNYQPPEGRYNDITKVYTQVEFKR

SEQ ID NO: 11640 - protein, 578 aa, Human
LSASARRPAAVAMFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 11641 - protein, 459 aa, Human
AGREEEREGRGESRTDGLARPRMQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 11642 - protein, 437 aa, Human
AVPGRGRGRRPGACRPGGRMSIEIPAGLTELLQGFTVEVLRHQPADLLEFALQHFTRLQQENERKGTARFGHEGRTWGDLGAAAGGGTPSKGVNFAEEPMQSDSEDGEEEEAAPADAGAFNAPVINRFTRRASVCAEAYNPDEEEDDAESRIIHPKTDDQRNRLQEACKDILLFKNLDPEQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEIARCSRGQYFGELALVTNKPRAASAHAIGTVKCLAMDVQAFERLLGPCMEIMKRNIATYEEQLVALFGTNMDIVEPTA

SEQ ID NO: 11643 - protein, 222 aa, Human
IVTKTHWVLLVTNSFPSGAAKMSGKSLLLKVILLGDGGVGKSSLMNRYVTNKFDSQAFHTIGVEFLNRDLEVDGRFVTLQIWDTAGQERFKSLRTPFYRGADCCLLTFSVDDRQSFENLGNWQKEFIYYADVKDPEHFPFVVLGNKVDKEDRQVTTEEAQTWCMENGDYPYLETSAKDDTNVTVAFEEAVRQVLAVEEQLEHCMLGHTIDLNSGSKAGSSCC

SEQ ID NO: 11644 - protein, 540 aa, Human
GTHISYLAAPEGWEMAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSTKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTFSGPLRPFFCLWSSGKKPLTICPIADGPERVTVIANAQDLSKEIPLSPMGEESAPRDADTLHSKLIPTQPSQGAP

SEQ ID NO: 11645 - protein, 234 aa, Human
QPGQARQAGLPQQPGHGPGVHHRGSQHLHHGLRGPEALDGHGTPAVGHPGPWMLPALQLSCPTPGVAIPVRCPPPCTWHYPDCQSPGWPHLHHVPGPALALTAAKHHAGGHSCLSAAVPRRQLPPGTWGLATIAQRVRTGQLQRPVPREGSRPTQGHTAGPWMGWMSDQGQPLSQDIPEGQGDVSPSPKAPASLPPVGPVRVALVTPASVHFLTQGPCTARTAFGPTDGHWLWS

SEQ ID NO: 11646 - protein, 280 aa, Human
VSVVLASAWAGVRAQDGAAVVRNPGLSASQEATPGANMSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYIDPIAMEYYNWGRFSKPPEDDDANSYENVLICKQKTTETGAQQEGIGGLCRGDLSLSLALKTGPTSGLCPSASPEEDEESEDYQNSASIHQWRESRKVMGQLQREASPGPVGSPDEEDGEPDYVNGEVAATEA

SEQ ID NO: 11647 - protein, 981 aa, Human
VLAAGRGRGAAGRSAWGSSKATMALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQGTASSLGFSPPALPPERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 11648 - protein, 981 aa, Human; identical to SEQ ID NO: 11647

SEQ ID NO: 11649 - protein, 250 aa, Human
RQMADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGMGSSRESRGGWDSRDDFNSGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 11650 - protein, 1043 aa, Human
MQKPSGLKPPGRGGKHSSPMGRTSTGSASSSAAVAASSKEGSPLHKQSSGPSSSPAAAAAPEKPGPKAAEVGDDFLGDFVVGERVWVNGVKPGVVQYLGETQFAPGQWAGVVLDDPVGKNDGAVGGVRYFECPALQGIFTRPSKLTRQPTAEGSGSDAHSVESLTAQNLSLHSGTATPPLTSRVIPLRESVLNSSVKTGNESGSNLSDSGSVKRGEKDLRLGDRVLVGGTKTGVVRYVGETDFAKGEWCGVELDEPLGKNDGAVAGTRYFQCPPKFGLFAPIHKVIRIGFPSTSPAKAKKTKRMAMGVSALTHSPSSSSISSVSSVASSVGGRPSRSGLLTETSSRYARKISGTTALQEALKEKQQHIEQLLAERDLERAEVAKATSHICEVEKEIALLKAQHEQYVAEAEEKLQRARLLVESVRKEKVDLSNQLEEERRKVEDLQFRVEEESITKGDLETQTQLEHARIGELEQSLLLEKAQAERLLRELADNRLTTVAEKSRVLQLEEELTLRRGEIEELQQCLLHSGPPPPDHPDAAEILRLRERLLSASKEHQRESGVLRDKYEKALKAYQAEVDKLRAANEKYAQEVAGLKDKVQQATSENMGLMDNWKSKLDSLASDHQKSLEDLKATLNSGPGAQQKEIGELKAVMEGIKMEHQLELGNLQAKHDLETAMHVKEKEALREKLQEAQEELAGLQRHWRAQLEVQASQHRLELQEAQDQRRDAELRVHELEKLDVEYRGQAQAIEFLKEQISLAEKKMLDYERLQRAEAQGKQEVESLREKLLVAENRLQAVEALCSSQHTHMIESNDISEETIRTKETVEGLQDKLNKRDKEVTALTSQTEMLRAQVSALESKCKSGEKKVDALLKEKRRLEAELETVSRKTHDASGQLVLISQELLRKERSLNELRVLLLEANRHSPGPERDLSREVHKAEWRIKEQKLKDDIRGLREKLTGLDKEKSLSDQRRYSLIDPSSAPELLRLQHQLMSTEDALRDALDQAQQVEKLMEAMRSCPDKAQTIGNSGSANGIHQQDKAQKQE

SEQ ID NO: 11651 - protein, 254 aa, Human
QLAVKTKMSGLRPGTQVDPEIELFVKAGSDGESIGNCPFCQRLFMILWLKGVKFNVTTVDMTRKPEELKDLAPGTNPPFLVYNKELKTDFIKIEEFLEQTLAPPRYPHLSPKYKESFDVGCNLFAKFSAYIKNTQKEANKNFEKSLLKEFKRLDDYLNTPLLDEIDPDSAEEPPVSRRLFLDGDQLTLADCSLLPKLNIIKVAAKKYRDFDIPAEFSGVWRYLHNAYAREEFTHTCPEDKEIENTYANVAKQKS

SEQ ID NO: 11652 - protein, 472 aa, Human [sequence omitted]

SEQ ID NO: 11653 - protein, 196 aa, Human
QTGRGRERGGGDTMSSPSPGKRRMDTDVVKLIESKHEVTILGGLNEFVVKFYGPQGTPYEGGVWKVRVDLPDKYPFKSPSIGFMNKIFHPNIDEASGTVCLDVINQTWTALYDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 11654 - protein, 98 aa, Human
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPEP

SEQ ID NO: 11655 - protein, 149 aa, Human
EKDQPQTVPPHLYMKYSEPPRRDGWTDRQPGSPVVSASIFLRSKRLFRNQHLICKLLFCFQPLPFVISSLMLWRWTQGPPRPSLFLWGGPVLEWEKGSQAHWESWFQSGCRICTFAKKFSLFGKFAPAFPGTPPFVPSVCRSTNLPATH

SEQ ID NO: 11656 - protein, 636 aa, Human
ERKHLGWMEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEVK

SEQ ID NO: 11657 - protein, 529 aa, Human
KMASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 11658 - protein, 504 aa, Human
PAMSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 11659 - protein, 376 aa, Human
GLKMLRSVWNFLKRHKKKCIFLGTVLGGVYILGKYGQKKIREIQEREAAEYIAQARRQYHFESNQRTCNMTVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLKEIRNLVEQHKSSSWINKDGSKPLLCHYMMPDEETPLAVQACGLSPRDITTIKLLNETRDMLESPDFSTVLNTCLNRGFSRLLDNMAEFFRPTEQDLQHGNSMNSLSSVSLPLAKIIPIVNGQIHSVCSETPSHFVQDLLTMEQVKDFAANVYEAFSTPQQLEK

SEQ ID NO: 11660 - protein, 541 aa, Human
PDGTKAAGVCGRSLGCGPGGTHAVQGNMADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 11661 - protein, 208 aa, Human
VFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 11662 - protein, 507 aa, Human
MRIPVDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 11663 - protein, 384 aa, Human
GGGSVLRARTGMLLGLAAMELKVWVDGIQRVVCGVSEQTTCQEVVIALAQAIGQTGRFVLVQRLREKERQLLPQECPVGAQATCGQFASDVQFVLRRTGPSLAGRPSSDSCPPPERCLIRASLPVKPRAALGCEPRKTLTPEPAPSLSRPGPAAPVTPTPGCCTDLRGLELRVQRNAEELGHEAFWEQELRREQAREREGQARLQALSAATAEHAARLQALDAQARALEAELQLAAEAPGPPSPMASATERLHQDLAVQERQSAEVQGSLALVSRALEAAERALQAQAQELEELNRELRQCNLQQFIQQTGAALPPPPRPDRGPPGTQGPLPPAREESLLGAPSESHAGAQPRPRGGPHDAELLEVAAAPAPEWCPLAAQPQAL

SEQ ID NO: 11664 - protein, 767 aa, Human
WMFLPEDKSYNGGGIGSSNRIMDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 11665 - protein, 454 aa, Human
ADFSTQVNSSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 11666 - protein, 591 aa, Human
ARVMYDFAAEPGNNELTVNEGEIITITNPDVGGGWLEGRNIKGERGLVPTDYVEILPSDGKDQFSCGNSVADQAFLDSLSASTAQASSSAASNNHQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 11667 - protein, 604 aa, Human
IMATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDKMSTERRKLLMEHIFKLQEFCNSMVKLCIDGYEYAYLKAIVLFSPDHPSLENMEQIEKFQEKAYVEFQDYITKTYPDDTYRLSRLLLRLPALRLMNATITEELFFKGLIGNIRIDSVIPHILKMEPADYNSQIIGHSI

SEQ ID NO: 11668 - protein, 464 aa, Human
FHMKTRTSEAMYNTMNIYELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNFEEFQKAFNCPPNSTMNRGMDSCRLW

SEQ ID NO: 11669 - protein, 416 aa, Human
PQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCWFIPLRLVFPYQTADNIHYWLIADIICDIIYLYDMLFIQPRLQFVRGGDIIVDSNELRKHYRTSPKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKARL

SEQ ID NO: 11670 - protein, 421 aa, Human
LRKTLGSQHAQLDSGLMLEVDTKMRRTMEQHTFWSIWLSRQGTKKRSQLDLELEIENMGAHLNAYTSREQTVYYAKAFSKDLPRAVEILADIIQNSTLGEAEIERERGVILREMQEVETNLQEVVFDYLHATAYQNTALGRTILGPTENIKSISRKDLVDYITTHYKGPRIVLAAAGGVSHDELLDLAKFHFGDSLCTHKGEIPALPPCKFTGSEIRVRDDKMPLAHLAIAVEAVGWAHPDTICLMVANTLIGNWDRSFGGGMNLSSKLAQLTCHGNLCHSFQSFNTSYTDTGLWGLYMVCESSTVADMLHVVQKEWMRLCTSVTESEVARARNLLKTNMLLQLDGSTPICEDIGRQMLCYNRRIPIPELEARIDAVNAETIREVCTKYIYNRSPAIAAVGPIKQLPDFKQIRSNMCWLRD

SEQ ID NO: 11671 - protein, 442 aa, Human
GAEAFGAAKMPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 11672 - protein, 543 aa, Human
APSARDVSRCAHRARPGAIMLLLPSAADGRGTAITHALTSASTLCQVEPVGRWFEAFVKRRNRNASASFQELEDKKELSEESEDEELQLEEFPMLKTLDPKDWKNQDHYAVLGLGHVRYKATQRQIKAAHKAMVLKHHPDKRKAAGEPIKEGDNDYFTCITKAYEMLSDPVKRRAFNSVDPTFDNSVPSKSEAKDNFFEVFTPVFERNSRYNFDSWREFSYLDEEEKEKAEWYQRQAELEAARLAKEKEEEEVRQQALLAKKEKDIQKKAIKKERQKLRNSCKTWNHFSDNEAERVKMMEEVEKLCDRLELASLQCLNETLTSCTKEVGKAALEKQIEEINEQIRKEKEEAEARMRQASKNTEKSTGGGGNGSKNWSEDDLQLLIKAVNLFPAGTNSRWEVIANYMNIHSSSGVKRTAKDVIGKAKSLQKLDPHQKDDINKKAFDKFKKEHGVVPQADNATPSERFEGPYTDFTPWTTEEQKLLEQALKTYPVNTPERWEKIAEAVPGRTKKDCMKRYKELVEMVKAKKAAQEQVLNASRAKK

SEQ ID NO: 11673 - protein, 284 aa, Human
PRLRYNGLRCWRILLRTRTASGRLFPRARSILYRARAKTTEVDSGARTQLRPASDPRIPRRPARVVWIAEGMPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 11674 - protein, 108 aa, Human
KKSLESINSRLQLVMKSGKYVLGYKQTLKMIRQGKAKLVILANNCPALRKSEIEYYAMLAKTGVHHYSGNNIELGTACGKYYRVCTLAIIDPGDSDIIRSMPEQTGEK

SEQ ID NO: 11675 - protein, 288 aa, Human
SKMAARVLRARGAAWAGGLLQRAAPCSLLPRLRTWTSSSNRSREDSWLKSLFVRKVDPRKDAHSNLLAKKETSNLYKLQFHNVKPECLEAYNKICQEVLPKIHEDKHYPCTLVGTWNTWYGEQDQAVHLWRYEGGYPALTEVMNKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 11676 - protein, 655 aa, Human
RGSGCSGEATLGSALRARWAGRWADGRGSPASAGGGVPHGARSAPPHPRPPALRRGSEEMPTQRDSSTMSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 11677 - protein, 218 aa, Human
GARHGDILAATMVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLALCALVATIWFPVCAHRETTIVSFGYSLYAGWIGAVLCLVGGCVILCCAGDAQAFGENRFYYTAGSSSPTHAKSAHV

SEQ ID NO: 11678 - protein, 565 aa, Human
LHCTMCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 11679 - protein, 214 aa, Human
RRPPGPPFGWRPPMLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVPKHVHWKKRTQTGLQTEGR

SEQ ID NO: 11680 - protein, 239 aa, Human
LLSPGAALPCLPPLAHHPHLPPRPPPPPPQHLAAPAHQPQPAAQLHRTTNFFIDNILRPDFGCKKEQPPPQLLVAAAARGGAGGGGRVERDRGQTAAGRDPVHPLGTRAPRRASLLCAPDANCGPPDGSQPAAAGRARLKLGTRLRRGGAAAAVADAAAAAAAKPSDTGGGGRWQAARGAPERRAPNTRSTATRLSYLWAQPTAGPWSKLTRSSLSYGPPGCTAHVIRIVHPPVRAPGS

SEQ ID NO: 11681 - protein, 296 aa, Human
PCRRGGAGAGRATPAGAVRGREPAPPWWRRPLAVQRQTHRVGSGLQPGREEGPGLRSGDSGPRRGAHTQAGRPGVRGLCAADQAPRASAPPMAEPLQPDPGAAEDAAAQAVETPGWKAPEDAGPQPGSYEIRHYGPAKWVSTSVESMDWDSAIQTGFTKLNSYIQGKNEKEMKIKMTAPVTSYVEPGSGPFSESTITISLYIPSEQQFDPPRPLESDVFIEDRAEMTVFVRSFDGFSSAQKNQEQLLTLASILREDGKVFDEKVYYTAGYNSPVKLLNRNNEVWLIQKNEPTKENE

SEQ ID NO: 11682 - protein, 1164 aa, Human
QRVMWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 11683 - protein, 530 aa, Human
PSPGPSMAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 11684 - protein, 560 aa, Human
PAGAGGARPRPVSAGRGGRGGGRGRGSGSSARPGAAMELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENEAFEFKKPVRPVSRGCLHSHGLQEGKDLFTQRQNSAPARMLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 11685 - protein, 335 aa, Human
GSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 11686 - protein, 590 aa, Human
STALTRPKPVCSQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 11687 - protein, 554 aa, Human
RLHEEIIDFYNFMSPCPEEAAMRREVVKRIETVVKDLWPTADVQIFGSFSTGLYLPTSDIDLVVFGKWERPPLQLLEQALRKHNVAEPCSIKVLDKATVPIIKLTDQETEVKVDISFNMETGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVDSDTPPCTTPSVYQFSLQAPAPLMAGLPTALPMPSGKPQPTTSRTLIMTTNNQTRFTIPPPTLGVAPVPCRQAGVEGTASLKAVHHMSSPAIPSASPNPLSSPHLYHKQHNGMKLSMKGSHGHTQGGGYSSVGSGGVRPPVGNRGHHQYNRTGWRRKKHTHTRDSLPVSLSR

SEQ ID NO: 11688 - protein, 1380 aa, Human
PCRSTYPAILMDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 11689 - protein, 412 aa, Human
ERRKEGAREKLLVGLTMKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 11690 - protein, 2404 aa, Human
NSCDLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHLFDCFKASWTNASKKQREKLLELIRRLAEDDKDGVMAHKVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 11691 - protein, 2404 aa, Human; identical to SEQ ID NO: 11690

SEQ ID NO: 11692 - protein, 689 aa, Human
AAPRLPALAAPAARAMPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 11693 - protein, 161 aa, Human
QNPGTMGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 11694 - protein, 381 aa, Human
MSGVVRTLSRCLLPAEAGGARERRAGSGARDAEREARRRSRDIDALLARERRAVRRLVKILLLGAGESGKSTFLKQMRIIHGREFDQKALLEFRDTIFDNILKGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 11695 - protein, 414 aa, Human
SERLQRGREEQPAGGGGESVSSWEEQNRGGAPAGAGGGPTMAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 11696 - protein, 1463 aa, Human
VGWEKIPLTPPGQRQESARNVLTNLDPAPKGTLKNVIVNRENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 11697 - protein, 500 aa, Human
WPSGGPGSMARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKG

SEQ ID NO: 11698 - protein, 604 aa, Human
SQRASARGRADRSEPSGAGRGAPCRALRGVPRRPRAPAPGHEPLRDSALSPPPVQRPRTRRRLPACRSPLRIPSTRMELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 11699 - protein, 604 aa, Human; identical to SEQ ID NO: 11698

SEQ ID NO: 11700 - protein, 629 aa, Human
FLIFGEGKCPHAGMAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLKEHVLQSSLSQEHKDPKATPP

SEQ ID NO: 11701 - protein, 420 aa, Human
APPSHCPRRSVSRAGPRTRRRERAWGASVDAAAAPPSEAASREARLPERSGLARCPGPECVPMEAPGLAQAAAAESDSRKVAEETPDGAPALCPSPEALSPEPPVYSLQDFDTLATVGTGTFGRVHLVKEKTAKHFFALKVMSIPDVIRLKQEQHVHNEKSVLKEVSHPFLIRLFWTWHDERFLYMLMEYVPGGELFSYLRNRGRFSSTTGLFYSAEIICAIEYLHSKEIVYRDLKPENILLDRDGHIKLTDFGFAKKLVDRTWTLCGTPEYLAPEVIQSKGHGRAVDWWALGILIFEMLSGFPPFFDDNPFGIYQKILAGKIDFPRHLDFHVKDLIKKLLVVDRTRRLGNMKNGANDVKHHRWFRSVDWEAVPQRKLKPPIVPKIAGDGDTSNFETYPENDWDTAAPVPQKDLEIFKNF

SEQ ID NO: 11702 - protein, 1244 aa, Human
ACPTAAGAAAVMGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 11703 - protein, 276 aa, Human
SHFRPFGSLTSTMAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 11704 - protein, 561 aa, Human
ESLTTMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLGSQSYEDMRGILYAAPQLRSIRGQPGPNHEEDADSYENMDNPDGPDPAWGGGGRMGTWSTR

SEQ ID NO: 11705 - protein, 802 aa, Human
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEFLLDKAAQRDNEEETTDDPRKLKPGEIDPNPETKPARPDPIDMDEDELEMLSEARARLANTQGKKAKRKAREKQLEEARRLAALQKRRELRAAGIEIQKKRKRKRGVDYNAEIPFEKKPALGFYDTSEENYQALDADFRKLRQQDLDGELRSEKEGRDRKKDKQHLKRKKESDLPSAILQTSGVSEFTKKRSKLVLPAPQISDAELQEVVKVGQASEIARQTAEESGITNSASSTLLSEYNVTNNSVALRTPRTPASQDRILQEAQNLMALTNVDTPLKGGLNTPLHESDFSGVTPQRQVVQTPNTVLSTPFRTPSNGAEGLTPRSGTTPKPVINSTPGRTPLRDKLNINPEDGMADYSDPSYVKQMERESREHLRLGLLGLPAPKNDFEIVLPENAEKELEEREIDDTYIEDAADVDARKQAIRDAERVKEMKRMHKAVQKDLPRPSEVNETILRPLNVEPPLTDLQKSEELIKKEMITMLHYDLLHHPYEPSGNKKGKTVGFGTNNSEHITYLEHNPYEKFSKEELKKAQDVLVQEMEVVKQGMSHGELSSEAYNQVWEECYSQVLYLPGQSRYTRANLASKKDRIESLEKRLEINRGHMTTEAKRAAKMEKKMKILLGGYQSRAMGLMKQLNDLWDQIEQAHLELRTFEELKKHEDSAIPRRLECLKEDVQRQQEREKELQHRYADLLLEKETLKSKF

SEQ ID NO: 11706 - protein, 568 aa, Human
RGVTTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 11707 - protein, 767 aa, Human
ARSSLLPVIPQPSSAPWGQDCCCHCHPLEPSTPSPPILRTATPAQPRVPVSTSPDPSAATPEGWSRDAVAPAACSPRVPVRAHAGPGARPQPCHWTQDKAQRTGPHVDSMDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 11708 - protein, 393 aa, Human
GPGAGAAAAATGGGGGALEAAMAKQYDSVECPFCDEVSKYEKLAKIGQGTFGEVFKARHRKTGQKVALKKVLMENEKEGFPITALREIKILQLLKHENVVNLIEICRTKASPYNRCKGSIYLVFDFCEHDLAGLLSNVLVKFTLSEIKRVMQMLLNGLYYIHRNKILHRDMKAANVLITRDGVLKLADFGLARAFSLAKNSQPNRYTNRVVTLWYRPPELLLGERDYGPPIDLWGAGCIMAEMWTRSPIMQANTEQHQLALISQLCGSITPEVWPNVDNYELYEKLELVKGQKRKVKDRLKAYVRDPYALDLIDKLLVLDPAQRIDSDDALNHDFFWSDPMPSDLKGMLSTHLTSMFEYLAPPRRKGSQITQQSTNQSRNPATTNQTEFERVF

SEQ ID NO: 11709 - protein, 202 aa, Human
HGSRDLGRMEEKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 11710 - protein, 670 aa, Human
CPSRCLRCCNRAASGRGAARRSRRRATMLLGASLVGVLLFSKLVLKLPWTQVGFSLLFLYLGSGGWRFIRVFIKTIRRDIFGGLVLLKVKAKVRQCLQERRTVPILFASTVRRHPDKTALIFEGTDTHWTFRQLDEYSSSVANFLQARGLASGDVAAIFMENRNEFVGLWLGMAKLGVEAALINTNLRRDALLHCLTTSRARALVFGSEMASAICEVHASLDPSLSLFCSGSWEPGAVPPSTEHLDPLLKDAPKHLPSCPDKGFTDKLFYIYTSGTTGLPKAAIVVHSRYYRMAALVYYGFRMRPNDIVYDCLPLYHSAGNIVGIGQCLLHGMTVVIRKKFSASRFWDDCIKYNCTIVQYIGELCRYLLNQPPREAENQHQVRMALGNGLRQSIWTNFSSRFHIPQVAEFYGATECNCSLGNFDSQVGACGFNSRILSFVYPIRLVRVNEDTMELIRGPDGVCIPCQPGEPGQLVGRIIQKDPLRRFDGYLNQGANNKKIAKDVFKKGDQAYLTGDVLVMDELGYLYFRDRTGDTFRWKGENVSTTEVEGTLSRLLDMADVAVYGVEVPGTEGRAGMAAVASPTGNCDLERFAQVLEKELPLYARPIFLRLLPELHKTGTYKFQKTELRKEGFDPAIVKDPLFYLDAQKGRYVPLDQEAYSRIQAGEEKL

SEQ ID NO: 11711 - protein, 198 aa, Human
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 11712 - protein, 1193 aa, Human
QRCVLLRTWEALAPATPAMPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTGKYAAESEAPGDDADCPGGRSQPGTALRLQDHPGLMATRPQPGREQTPAALSRRALRPREGGAAHTQARTAGSLRPE

SEQ ID NO: 11713 - protein, 224 aa, Human
LRRSSRSHPGPKGAAPAAAAAAAGELLKFGVQALLAARPFHSHLAVLKAEQAAVFKFPLAPLGCSGLSSALLAAGPGLPGAAGAPHLPLELQLRGKLEAAGPGEPGTKAKKGRRSRTVFTELQLMGLEKRFEKQKYLSTPDRIDLAESLGLSQLQVKTWYQNRRMKWKKIVLQGGGLESPTKPKGRPKKNSIPTSEQLTEQERAKDAEKPAEVPGEPSDRSRED

SEQ ID NO: 11714 - protein, 644 aa, Human
FNTMGPPLKLFKNQKYQELKQECIKDSRLFCDPTFLPENDSLFYNRLLPGKVVWKRPQDICDDPHLIVGNISNHQLTQGRLGHKPMVSAFSCLAVQESHWTKTIPNHKEQEWDPQKTEKYAGIFHFRFWHFGEWTEVVIDDLLPTINGDLVFSFSTSMNEFWNALLEKAYAKLLGCYEALDGLTITDIIVDFTGTLAETVDMQKGRYTELVEEKYKLFGELYKTFTKGGLICCSIESPNQEEQEVETDWGLLKGHTYTMTDIRKIRLGERLVEVFSAEKVYMVRLRNPLGRQEWSGPWSEISEEWQQLTASDRKNLGLVMSDDGEFWMSLEDFCRNFHKLNVCRNVNNPIFGRKELESVLGCWTVDDDPLMNRSGGCYNNRDTFLQNPQYIFTVPEDGHKVIMSLQQKDLRTYRRMGRPDNYIIGFELFKVEMNRKFRLHHLYIQERAGTSTYIDTRTVFLSKYLKKGNYVLVPTMFQHGRTSEFLLRIFSEVPVQLRELTLDMPKMSCWNLARGYPKVVTQITVHSAEDLEKKYANETVNPYLVIKCGKEEVRSPVQKNTVHAIFDTQAIFYRRTTDIPIIVQVWNSRKFCDQFLGQVTLDADPSDCRDLKSLYLRKKGGPTAKVKQGHISFKVISSDDLTEL

SEQ ID NO: 11715 - protein, 538 aa, Human
LPLQKEQWPWLLRGKSPAHPLQMPVPERPAAGPDSPRPGTRRAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFRELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 11716 - protein, 580 aa, Human [sequence omitted]

SEQ ID NO: 11717 - protein, 454 aa, Human
IMKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVDILMEFLLNVTTAPEFRRWEVADLQPQLKIDKAVAFQNPQTHVIENLHAAAYRNALANPLYCPDYRIGKVTSEELHYFVQNHFTSARMALIGLGVSHPVLKQVAEQFLNMRGGLGLSGAKANYRGGEIREQNGDSLVHAAFVAESAVAGSAEANAFSVLQHVLGAGPHVKRGSNTTSHLHQAVAKATQQPFDVSAFNASYSDSGLFGIYTISQATAAGDVIKAAYNQVKTIAQGNLSNTDVQAAKNKLKAGYLMSVESSECFLEEVGSQALVAGSYMPPSTVLQQIDSVANADIINAAKKFVSGQKSMAASGNLGHTPFVDEL

SEQ ID NO: 11718 - protein, 673 aa, Human
GRRADGERGRRRRRRRRRLGLERPQPTSRGRAPGASRAEEKMEELVVEVRGSNGAFYKAFVKDVHEDSITVAFENNWQPDRQIPFHDVRFPPPVGYNKDINESDEVEVYSRANEKEPCCWWLAKVRMIKGEFYVIEYAACDATYNEIVTIERLRSVNPNKPATKDTFHKIKLDVPEDLRQMCAKEAAHKDFKKAVGAFSVTYDPENYQLVILSINEVTSKRAHMLIDMHFRSLRTKLSLIMRNEEASKQLESSRQLASRFHEQFIVREDLMGLAIGTHGANIQQARKVPGVTAIDLDEDTCTFHIYGEDQDAVKKARSFLEFAEDVIQVPRNLVGKVIGKNGKLIQEIVDKSGVVRVRIEAENEKNVPQEEEIMPPNSLPSNNSRVGPNAPEEKKHLDIKENSTHFSQPNSTKVQRVLVASSVVAGESQKPELKAWQGMVPFVFVGTKDSIANATVLLDYHLNYLKEVDQLRLERLQIDEQLRQIGASSRPPPNRTDKEKSYVTDDGQGMGRGSRPYRNRGHGRRGPGYTSGTNSEASNASETESDHRDELSDWSLAPTEEERESFLRRGDGRRRGGGGRGQGGRGRGGGFKGNDDHSRTDNRPRNPREAKGRTTDGSLQIRVDCNNERSVHTKTLQNTSSEGSRLRTGKDRNQKKEKPDSVDGQQPLVNGVP

SEQ ID NO: 11719 - protein, 225 aa, Human
ARSGRWLRNGFKRKMEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGK

SEQ ID NO: 11720 - protein, 271 aa, Human
PRGQQRGAHALATHLAFSPRASRPGFLVFLGALSGLRLRQGAEGGDSETGQGGGKRTRVGKGDNGMSTGSVSDPEEMELRGLQREYPVPASKRPPLRGVERSYASPSDNSSAEEEDPDGEEERCALGTAGSAEGCKRKRPRVAGGGGAGGSAGGGGKKPLPAKGSAAECKQSQRNAANARERARMRVLSKAFSRLKTSLPWVPPDTKLSKLDTLRLASSYIAHLRQLLQEDRYENGYVHPVNLTWPFVVSGRPDSDTKEVSAANRLCGTTA

SEQ ID NO: 11721 - protein, 413 aa, Human
LCAARARMRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRATVELYEDRKEGYPAVKTLVTLGKEDLSIKISDLGGGVPLRKIDRLFNYMYSTAPRPSLEPTRAAPLAGFGYGLPISRLYARYFQGDLKLYSMEGVGTDAVIYLKALSSESFERLPVFNKSAWRHYKTTPEADDWSNPSSEPRDASKYKAKQ

SEQ ID NO: 11722 - protein, 809 aa, Human
ELKAMDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 11723 - protein, 868 aa, Human
FYRSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 11724 - protein, 313 aa, Human
EFGCWGKGKRAKKGPAEVFSNNDEGLINKKLPKELLLRTFAQNCRNIEHLNLNGCTKITDSEGCRNLEYLNLSWCDQITKDGIEALVRGCRGLKALLLRGCTQLEDEALKHIQNYCHELVSLNLQSCSRITDEGVVQICRGCHRLQALCLSGCSNLTDASLTALGLNCPRLQILEAARCSHLTDAGFTLLARNCHELEKMDLEECILSLSHCELITDDGILHLSNSTCGHERLRVLELDNCLLITDVALEHLENCRGLERLELYDCQQVTRAGIKRMRAQLPHVKVHAYFAPVTPPTAVAGSGQRLCRCCVIL

SEQ ID NO: 11725 - protein, 300 aa, Human
AGVPAAAAMQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 11726 - protein, 476 aa, Human
RAALPRRAKRPLAMGSPAHRPALLLLLPPLLLLLLRVPPSRSFPGSGDSPLEDDEVGYSHPRYKDTPWCSPIKVKYGDVYCRAPQGGYYKTALGTRCDIRCQKGYELHGSSLLICQSNKRWSDKVICKQKRCPTLAMPANGGFKCVDGAYFNSRCEYYCSPGYTLKGERTVTCMDNKAWSGRPASCVDMEPPRIKCPSVKERIAEPNKLTVRVSWETPEGRDTADGILTDVILKGLPPGSNFPEGDHKIQYTVYDRAENKGTCKFRVKVRVKRCGKLNAPENGYMKCSSDGDNYGATCEFSCIGGYELQGSPARVCQSNLAWSGTEPTCAAMNVNVGVRTAAALLDQFYEKRRLLIVSTPTARNLLYRLQLGMLQQAQCGLDLRHITVVELVGVFPTLIGRIGAKIMPPALALQLRLLLRIPLYSFSMVLVDKHGMDKERYVSLVMPVALFNLIDTFPLRKEEMVLQAEMSQTCNT

SEQ ID NO: 11727 - protein, 447 aa, Human
RAEMKFPASVLASVFLFVAETTAALSLSSTYRSGGDRMWQALTLLFSLLPCALVQLTLLFVHRDLSRDRPLVLLLHLLQLGPLFRCFEVFCIYFQSGNNEEPYVSITKKRQMPKNGLSEEIEKEVGQAEGKLITHRSAFSRASVIQAFLGSAPQLTLQLYISVMQQDVTVGRSLLMTISLLSIVYGALRCNILAIKIKYDEYEVKVKPLAYVCIFLWRSFEIATRVVVLVLFTSVLKTWVVVIILINFFSFFLYPWILFWCSGSPFPENIEKALSRVGTTIVLCFLTLLYTGINMFCWSAVQLKIDSPDLISKSHNWYQLLVYYMIRFIENAILLLLWYLFKTDIYMYVCAPLLVLQLLIGYCTAILFMLVFYQFFHPCKKLFSSSVSEGFQRWLRCFCWACRQQKPCEPIGKEDLQSSRDRDETPSSSKTSPEPGQFLNAEDLCSA

SEQ ID NO: 11728 - protein, 552 aa, Human
SGCWGCKARAVSCWRCREEDAGARLPSSAAAAAMIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCAGIWHNFVLALLGILALVLLPVILLPFYYTGVGVLITEVAEDSPAIGPRGLFVGDLVTHLQDCPVTNVQDWNECLDTIAYEPQIGYCISASTLQQLSFPVRAYKRLDGSTECCNNHSLTDVCFSYRNNFNKRLHTCLPARKAVEATQVCRTNKDCKKSSSSSFCIIPSLETHTRLIKVKHPPQIDMLYVGHPLHLHYTVSITSFIPRFNFLSIDLPVVVETFVKYLISLSGALAIVNAVPCFALDGQWILNSFLDATLTSVIGDNDVKDLIGFFILLGGSVLLAANVTLGLWMVTAR

SEQ ID NO: 11729 - protein, 749 aa, Human
LAAMAWIRSTCILFFTLLFAHIAAVPIKYLPEENVHDADFGEQKDISEINLAAGLDLFQGDILLQKSRNGLRDPNTRWTFPIPYILADNLGLNAKGAILYAFEMFRLKSCVDFKPYEGESSYIIFQQFDGCWSEVGDQHVGQNISIGQGCAYKAIIEHEILHALGFYHEQSRTDRDDYVNIWWDQILSGYQHNFDTYDDSLITDLNTPYDYESLMHYQPFSFNKNASVPTITAKIPEFNSIIGQRLDFSAIDLERLNRMYNCTTTHTLLDHCTFEKANICGMIQGTRDDTDWAHQDSAQAGEVDHTLLGQCTGAGYFMQFSTSSGSAEEAALLESRILYPKRKQQCLQFFYKMTGSPSDRLVVWVRRDDSTGNVRKLVKVQTFQGDDDHNWKIAHVVLKEEQKFRYLFQGTKGDPQNSTGGIYLDDITLTETPCPTGVWTVRNFSQVLENTSKGDKLQSPRFYNSEGYGFGVTLYPNSRESSGYLRLAFHVCSGENDAILEWPVENRQVIITILDQEPDVRNRMSSSMVFTTSKSHTSPAINDTVIWDRPSRVGTYHTDCNCFRSIDLGWSGFISHQMLKRRSFLKNDDLIIFVDFEDITHLSQTEVPTKGKRLSPQGLILQGQEQQVSEEGSGKAMLEEALPVSLSQGQPSRQKRSVENTGPLEDHNWPQYFRDPCDPNPCQNDGICVNVKGMASCRCISGHAFFYTGERCQAVQVHGSVLGMVIGGTAGVIFLTFSIIAILSQRPRK

SEQ ID NO: 11730 - protein, 564 aa, Human
FQLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSYRAEQERFLYYQRKEGHSVAAGTPGPL

SEQ ID NO: 11731 - protein, 509 aa, Human
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 11732 - protein, 536 aa, Human
QTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 11733 - protein, 107 aa, Human
ARALPASGAGNRPQGQDSRRGRRMALSVLRLALLLLAVTFAASLIPQFGLFSKYRTPNCSQYRLPGCPRHFNPVCGSDMSTYANECTLCMKIREGGHNIKIIRNGPC

SEQ ID NO: 11734 - protein, 633 aa, Human
AQNLGSRRRHPPPQPASAAAGPAPAPASAAAARPRPPAPRASRGRRLHASQCSPRPACNPARPPQLCPLQLQPRAAPPRPDTSSPACSSRMAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 11735 - protein, 473 aa, Human
EAEPTLLAMGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 11736 - protein, 554 aa, Human
FLPATPRRLWALSIVSFSSAGAAMAAVKTLNPKAEVARAQAALAVNISAARGLQDVLRTNLGPKGTMKMLVSGAGDIKLTKDGNVLLHEMQIQHPTASLIAKVATAQDDITGDGTTSNVLIIGELLKQADLYISEGLHPRIITEGFEAAKEKALQFLEEVKVSREMDRETLIDVARTSLRTKVHAELADVLTEAVVDSILAIKKQDEPIDLFMIEIMEMKHKSETDTSLIRGLVLDHGARHPDMKKRVEDAYILTCNVSLEYEKTEVNSGFFYKSAEEREKLVKAERKFIEDRVKKIIELKRKVCGDSDKGFVVINQKGIDPFSLDALSKEGIVALRRAKRRNMERLTLACGGVALNSFDDLSPDCLGHAGLVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSGFDLQETLVKIQAEHSESGQLVGVDLNTGEPMVAAEVGVWDNYCVKKQLLHSCTVIATNILLVDEIMRAGMSSLKG

SEQ ID NO: 11737 - protein, 401 aa, Human
MEKSKNFRIDALLAVDPPRAASAQSAPLALVTSLAAAASGTGGGGGGGGASGGTSGSCSPASSEPPAAPADRLRAESPSPPRLLAAHCALLPKPGFLGAGGGGGGTGGGHGGPHHHAHPGAAAAAAAAAAAAAAGGLALGLHPGGAQGGAGLPAQAALYGHPVYGYSAAAAAAALAGQHPALSYSYPQVQGAHPAHPADPIKLGAGTFQLDQWLRASTAGMILPKMPDFNSQAQSNLLGKCRRPRTAFTSQQLLELEHQFKLNKYLSRPKRFEVATSLMLTETQVKIWFQNRRMKWKRSKKAKEQAAQEAEKQKGGGGGAGKGGAEEPGAEELLGPPAPGDKGSGRRLRDLRDSDPEEDEDEDDEDHFPYSNGASVHAASSDCSSEDDSPPPRPSHQPAPQ

SEQ ID NO: 11738 - protein, 134 aa, Human
YLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 11739 - protein, 122 aa, Human
QRPERHQAQPWHHTPPSSADEMQRLCVYVLIFALALAAFSEASWKPRSQQPDAPLGTGANRDLELPWLEQQGPASHHRRQLGPQGPPHLVADPSKKQGPWLEEEEEAYGWMDFGRRSAEDEN

SEQ ID NO: 11740 - protein, 341 aa, Human
LLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 11741 - protein, 414 aa, Human
LEARSLAVAMGDTVVEPAPLKPTSEPTSGPPGNNGGSLLSVITEGVGELSVIDPEVAQKACQEVLEKVKLLHGGVAVSSRGTPLELVNGDGVDSEIRCLDDPPAQIREEEDEMGAAVASGTAKGARRRRQNNSAKQSWLLRLFESKLFDISMAISYLYNSKEPGVQAYIGNRLFCFRNEDVDFYLPQLLNMYIHMDEDVGDAIKPYIVHRCRQSINFSLQCALLLGAYSSDMHISTQRHSRGTKLRKLILSDELKPAHRKRELPSLSPAPDTGLSPSKRTHQRSKSDATASISLSSNLKRTASNPKVENEDEPVRLAPEREFIKSLMAIGKRLATLPTKEQKTQRLISELSLLNHKLPARVWLPTAGFDHHVVRVPHTQAVVLNSKDKSLNVKTLTPPVSLPGSPRTEFGVRGP

SEQ ID NO: 11742 - protein, 429 aa, Human
PVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGILECEKPLPLKTALQKKRSYGNAFHHPSAVRLQESDSLATSIDPKEDHNYSASSMAAQRCASRSSVSSLSSVDEVYEFIPKNSHVGSDGSEGFHSEEDTDVDYEDDPLGDSGYASQPCAKISEKGQSGKKMRKQTCQEIDEELKEAAGSLLHLAGIRTCLGSLISTAKTQNQKQRKK

SEQ ID NO: 11743 - DNA, 44244 bp, Human
  misc_feature (1)...(44244): n = A,T,C or G
tttcttgcgtttttgttttggtttgtagcttatcagttaacattagtgttagtgtattttatgtatagcccaagacaattctttttcttccagtgtggcccagggaagccaaaagattggacactgctggcttacaccatcaccaatagtgggacaaatctgatattaaatgcctcctaatgtaatacaatattaactacacagtatgacctttgaagtatccttatccaatgtttaatctgaactcctcaagcctctggtaacttgcaactgataggaaatacaaaatctagaggtacaaaataaataaaatcggacaatccagcattagggcattcttcatgacaactgcttggtatcttaaatttgtttaaaaagacagttattattgggaaaaatgaattagattaaaagctttagattaaaagaagccaaagaaagttaaagcccaacttcaatgggcaatcattcataggatcctggttcaaaaacaaactatttacaaaaggtattctggagacaactggacaactggagaaatgtaaatattctctggaccttaaataatagtagcgaataattgttaattttcattgatgtgataaaggttttataggaaatggttatataggaaaatgtccttgtaggagacatatagctaaagtattctgaactgaagtgtcttatctacaacctacagatctgagaaaaataaaaccaacaaccaaaacacacacacataggtacacatataaatatataaataaatatggaaaaatatttgaatctaggtgataatgatattgagaagaaattactcaggccgatagtacgagtatgggagtcctcagtgtaaaaagtgaagtagaggttcctcttcaaatggactttcctttccgtctaattaggaataaacagtaacttctcttaaaagcaaaatttattcaaagaactgtgctaacatattggaggccgaaacaatgaggttcgtgatcaactcagtatatcactggaggctatatgagtaagcagcaaactgtttctcataaatgcagaacgttggcgaactgacaaactgcgtatgccacccaggaggactgctgagggtagttacgatctaggcacaaatgtttcttatgattaggcataattgaagcctgtcagtaacaatatgaacctgtgatcaattaagcagctgaccaatcgttaccacctcctccctgctcctgttacccaaaaaataggaagggctgtggaagctctgtggctgcctttgctcacgagaagcagggagctctcttcttcttcccctggccctttccttaaaacagttccttttgtcttaagttatcatttctacgttcgtcccttcatttgatctcacaatgatggtctcaagcagtaacagtagtaactgctgtaacgatggtctcaagtagtaaccgtggcagttggccacactaacattctttgatatctgttggccgtaataaagaaatcaatgtactttgtgctcttagctgccacattttagcctagatatttgccctggcatgcttatactggtccaaggaagcattaggccatagcctgttttcttccttatctggaggtgtttttacctttctcagcattccacaagttgcttcctccttcctttgttctcctctgtctttgcctcttttggaaagttctaagttgctagccaatcaggacaagtacagaggtccccttccagccaatggaaaccggacacggtagtagggtgcacgtgtcaggttataaatgaccctgtctcctttatgcgtgtgtgctctcgtggcaagactactagcgagcggcaacctttctgcagaaagtaaactagccttgctaagagctcctttgtctcagtgttgatttttgcaacactgagcgcccgttcccaacatcagtaaggcttttctttttaatgaaaagcagccccaaatccttttctaagagcagcctgtgaagtcgagctgcaggcacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttacttaccaccaccactttgaaggctttcttgcctataccaggacaaactcagctctttatcccttttccgaattttcctggtactttcactttgaatacagcgcttaattaacattctgccttgtacctaggactaacacagtataaattcccagaagacaaagtaggggaatacaataacaggatatagaattttaacagctaaattagatgaatttatgggtgacctttattgggcaaaagaaaatgttaagttagtataagatttagtataagctaccatctcaaaactcagggtctcactggaagagaaagtgactccaggtagaattcctcagggagacattcacttccatcattcgctgaaccaggagctttggacagcctcggattgcaccggcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccgttctctccgggtaaaggtgaaggctgaccacgggggccgctctccctccaggccccagccacgccctctaacccaggttcccgtcctgcaccgcgccgcaagtccccccaccgttcagcgcaaccgggccctcccagccccgccgccgtccccctcccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtgagagggagcccagcggtgcggtggggctggaacatgggtattgtggtgtcggagcagggggccgtgggccaaaaataggtgcggccgggaggagtgggaagtcgggctgaggaaggagccagcctaggggcccccaacctgctttcacgcctcctaccaccggacggaacgtagcctagcgtttcattttccgtatcctcccgtcaggcgaccccgttatagccggcatcctctctttagaatatcgtttttctttctctggtaaaccctccaaatatttaccgcgggaatcccacctttttccaaagtgaccccgtctctgtgtcagaaccacgggaaaaagaaaaatggagcagctactccttgaaatacttaatgtttaataagcttttcgttgtaacgtttccacgttgcttacgggaaaaaaaaaagtaaaaaaaaaacctgcagaattttatgtgaacttgtgtgtatattctagtattggatcttaatagattctaaataagtttgtcactagatgaattttggtatcttaaatattcttgatatgttcacaccactgccatttagatgtcacttaaaattaagttaaagttatgtcttggaccaaaaaagctgcggttttagaataatcctaaagaattgctgcccatgttttgctggtgttatgcaagttaatgtgcagtgaaggcagaaattgggagatttcagctatttttaactcctacaccagaaaagcagatttctcaacctccaaggaaggatctaaaaaaaacctgatatagaaaacttacaccctttttctcttctttaacccataaaactgacactcttatattcccaagaaatgcacaaaagtgttcaattctagtggtgctgtttcgatatttggaatttcattgttctagacagagagcccgaagtaataaaaccaatagttatatagcattaggctttcaaaacattatcgtactttaatcgtccgaaaatacgcagtgagattagtcccattttttggttttgaacggaagctataagcagtttgtaaacctgtctacggccacaaatatggttgtggaacctagattcacattcagcaattataactccagatcccgtgctgtttctgttttctatttgcaaaccacctctctaattaactggctaactttgttatgtaattaacaggttgatgggcattgtattctggtaatagcaacctttgcactttgttccatgtaacatattttcctgaacagtcacatgtgaagtgactttttccctatttaaattccctcggttggccaggtgcggcggctcacggttgtgatcctagcaccttgggaggcctcggcgggttgatcacttaaggccaggagttcgagaccagcctggccaaagcagggaaaccctgtctttactaaaaataggaaaaattagctgggcatggtagcatatgcctgtaatcccaggaggctgagtctgcagtgagcggagatctctccaccgcactctagcctgggtgacagagggagactctgtcaaaaaaaaaaaaaaaagtctctcagtagaccatttaacctggtttgagttctgacttttgtgcatggtatttaaaaacgcatttataatagagtcaggttttttgttctgatttttgtggaatgttttcctttgttatggaacctagtgaccaattaggatactaacagaaagatcagtatagcaaggtggttaatagcatgcgctcttgatagtaaatgttagaatcctggttgcactaatagtagagtgactttgcctaatttagttgactttctgagccttcgtttcttcacatgcgaaagtggaataaaagtaatggcttaatcctagacttgacctgggattcagtgaattaacctgtgtaacgcgactgtaaatcagagtagatttggtctgtgactgctggacaataagcaccagagaaactgtttcacttttttttttttttttttttttgagacggagtcttgctctgtcacccaggctggaatgcaatggtgcagtctaggctcactgcaacctccgccttccgggttcaagcgattctcctgcctcagcgtcccgagtagctgggactacaggtgcgtgccaccacacctggctaatttttgtatttttagtagaaatggggtttcaccatgttggtcaggctggtctcaaacccctgacctcgtgatccgcccacctcagcctcccaaagtgctgggattacacgcatgagccaccccacctggcactgtttcactttcaaaataaaattaatgaagatgcaaagaaaatgcgagttttcatactctgtatgtttttattactgtagtatgaggtatgttatttggaaagcactgtttcaattacaaatatttgacactcttaattatattgtcaccttacatgtaggaattcgtcttttataagttgaaattgtcatctacaaagacagtttctttttacggattttgaaaaacataagaatttaaataaagaaactttagtatattcttcagctgctcttttctcttagtatctaagcttgttaaaattgctggatagttcaattaaaatcttttacagtgaaaattgtgtaattttgactgtcctgaaacctttactcaagaacaccattgtggttcccagtttggcagctttaataaatgcaaatttttacttttgtatccattaagctgtcatgaatataaaaatgggttgcaaaacaataatatatgtatatttgattgtttctttatatgttcctttgaagaaatatgactatatttcagatcctaagacaagtagtgtattagtagtttagaagagggatggcaaacgtgtttgtaaaggaacggatagtacatgtttttggctttgtgaaccagatggtctctgtggtaactacttagatctgctgtgaaagcggcaatagacagcatgatgtggctgccctggtttggtgactccttgctcagaacattgtaagaatccctgtagacagcagaaaatacagaacatggttttatgctaatttgttttgttagagtggggtatcctaaaaaatgagatcctctgaggggaaggtttccagaggcatgcatgggaggctcacagtgacagggtatcaaagttgatggactaggcaactcttgaacacagtatgttcacttccagcctatcgttctccccaccccaactctccaaccattaatgtcctaggagcttgtaagatacccagaatagtggtcctacatctactactacccttgactgttgtttgtcctaaaccctccacttcagtagtataaataccactgactttattttcattactttttaaaaacatctcctctgtaataggaatttatataactgataattggcttatttaaattatgattgaaggcatttaaatagtgatgactttaaaaactatgagtatggtcaaaccagttgctgtactcacttatgattatcagtagtctcttatctgattaatgtttaacttatcaaatttattttaataaaagtgttctttacaggtcctgagaagtatttctcgttttcattggagatcacagcatacaaaagccaatcgacaacgtgaaccaggattaggatttagttttggtatatgttcggttctatcttttgactttaaacttatacatatgaagctttatatgtttgtttggaatatgtttgtaaataaacttaataatgtctttcaatgagtagaaccagtccactgtccacagatagtttacaataactcacactccattcttcctgatctcattttcttcctcagtatactacactgtacattagatctgttttagcagcatacatacacttaaattccttcctttttttctgagtgtttagcccaaaataaatgagatttactgatatatatgaatagtcttcaacttacatatctgaatgccacaaatacattttaaaaacacttgttagattacaattctaggtgcctggtaataagctaaagcttgtttttgctataatatatccaaattgcaattttggtactattagatgaagttctcactcctgggaccagggagccatgattttttttcctctgccctctataaaatgaaaactacacacaaaaaatttgaaataatatctatctttggcattcttggccttctaaagtgcttcttcaaaatttttattttttctctagttaaaaaccatttactcaatttatttggtctcagaaaatagttaaaggcagctgcgataactcacagctaggtacaaatgacaatctcaaagctctccagagttattttttttattatttgttgtgttttttaaagatttttcccttttctttataaaggttttttttttttcttaccagaatttaatgaaatttttcttttctttttctttctttcttttttcttttttttttttttttttaagatgaggtttcattgtctcattatgttgcccaggccgatcttgaactcctaggctcaagcagtcctcttatttcagcctcccaaagtgctgggattataggcatgagctactgcacccagaccaaatgaaaagtttctgtgttttttttttttttttctgtgacttctagccaaagactggatgaaaattttctcttttcttttttttgagacagagtctcactctgtcacccaggctggtgtgcaagtggctcactgcaacctctacctcccaggatcaagcgattctcctgccccagcctcctgagtagctgggactacaggtgtgggtcatcatgcctggctaatttctatatttttagtagggatggggttttgccacgttggccaggctggtctcgaacagctgaagacaagtgatccacccacctctgcctcccaaagtgctgggattacaggcatgaaccactgtgcccaacctaaatgaaaattttttttcttttctctttctgtagccaaagactaaatgaaagttttcaagcactgtgaggatagccatttgggatggtggatttttttttttttttttttttttttttgagactgagtcttgctctgttgctcaggctggattgcagtagctccatctgggctcattgcaacctctgcctcctgggttcaagcgattctcctgcctcagccacccaagtagctgagattacaggtgtgggccaccatacctggctaatttttatattattagtagatatgaggtttcgccatgttggcaacgctggtctcgaactcctggcctcaagtgatccacccgtcttgtcctcccaaagtgggattatgggcattagccagcatgcccagccagggtagtggatcatactgagataattagcattaatttggtatgattgcttgtcactttaaatttctctctcagtagtaagagacttgcaggagaaatctatggtggttcactgagtgacagaggatgagttagatataattgtttgggagggagattgtgaagttcaatacgggtctattccttgaaccagttgcatctggttctttatctgtaaagtggaaataatatctataacacagaatttctatgaagattaaattatatgctgtatttaaagcccctagcacttagtgactggatcaaagtagtttctcaataaataatacataatacatacttgtcatttttccttttttttttttttaagagacagggtttcactctgtcacccaagctggatgcaaccttgacctctggggctccatggattctctggcctcagcttcctgagcagttaggacaataggtccatgtcaaccacacctagctgattttttaaatttttaaatgttttgttgagacaggatcttgctatattgctcaggctggccccaaactcctggcctcaaatggttcacctgcctcagcctcccaaaattctagaattataggcatgagctaccgtgcccagactttctctaccctctatctacctgcaagattgctatcaactggcaccaatcttagaagtaaagctgtgatagagagaacactggactgaaactcttaagtatacttctgctaattcattgtgagactgatactagaatttccttactctgcattagtttatcaataaaaagagagatttggctgggcgcagtggctcgggcctgtaatcccagcactttgggaggccgaggtgggcggatcacgaggtcagaagatcgagatcctggtgaaaccccgtctctactaaaaatacaaaaaaaaaaattagccgggcgcggtggcaggcacctgtagtcccagctgctcaggaggctgagacaggagaatggcgtgaacccgggaggcggagcttgcagtgagcctagattgcgccactgcactccagtctgggcgacagagcgagactccgtctcaaaaaaaaaaaaaaaaaaaaaaaaaagagatttgatcttatgctcttcaattcagcaccagaattcagcttttatgtattgtttctcacatccccatacaaatgattactgtagtcttaaacattcctctgtgcatttgctctcatttttcttgcttgaaataccctattatctcttaaattttacctaatctttgacgttagatgcaaccacattaaaacacaaggataccatggatttgaaaagatgcagttagcaattgactcctctcctcaatcaagccaccatactaatttcattaattttaaaacaatcccttattttatgtaaacaaattgttggacaccatttattagcattgcagcaggattttatgttattatcttttgaaaaacctttctaccacttttaccagttgctttgtgctaatttataagcttgtctgagtttaaaggagctgtaagcctaggcatggtgtctcatgcttgtaatcccagcactttaggagaccacggcaggaggattgcttgaggccacgagttcaagaccagcctggcatcatagtgagaccctgtctctgtgaaaacaaaaaaaatgaaatagatagggtgaggtggctcccagcactttgggaggccaagatgggagaatcatttgagcccaggagttctagacccatttgggcaacatggcaaaaccctgtatctacaaaaattacaaaaattagccagatatggtggcatgtgcctgtgatcccagctagttgagaagctgtggtgggaagatcatttaaggccaggaggtcgaggctacagtgagtcgtaattgcaccactgcactccagcctgagtgacaaaatgagactgtctcaaaaaaaaaaagcaaaattatgatattgatattcttatatgacactttgaaataagttttattgctttatgtcactgagtgtgtttcatctatttcgttagattgattcttgtcgtcagggagatgtcttgtatattagtttcacttcagtgttagcaaacatttgataaattggcttaggaactaataataagttaaacgttttttatatcaccaattggaaaagaaaaactcacttgagctctacaggttaatatctattactcatttgtaaaagttaaaaatcttacctatttcctttagcatttgtattgacataggtttatttatattgtgtagtgaactcttgattagtcaaaaaatgcactgtagtctgagtttctgataatcaaggatttaagtccccacaataaatacacatttctacatactgacttcataggacatttttccttgttatccagttttaacttttctaaataattttcccttagagttcaccgaacagcagaaagaatttcaagctactgctcgtaaatttgccagagaggaaatcatcccagtggctgcagaatatgataaaactggtgaagtaggtatatacattttaaagagggaaaaatcttttacattttttacaagattatgtaatcaaactatctggatttcaaaatatattttaactcagttctttttcttctagtatccagtccccctaattagaagagcctgggaacttggtttaatgaacacacacattccagagaactgtggtaagctttctttatatttttaatactggaatgcatatgagtaagaaaaattgtggaactctactcagtcatttttttcaaatatttcttgccattaaatgactttctacctttgtcttcctgctcagactacagtgtttgcccacttttggaagcttgcactctatacctagatgcgtttttccttcttctaactggttccaaccttaacttgcacctaaaccttggtaacttccgtttctagagttggtcaatttgttgtgttttattcctatcttctatattacattttattgagtcttttttgtgaaccatgattcttttcctcagacccagttttagagttgaattgagttttaacaaaatcaagttagaacaggaatacaggttcaaattacaaatagtaaaataattttttgaaaattttagagctttaagaaagtataatttcttattgtgccagccagaacacatgtagatattatattgcaaatttccttttaaaacaaattttggtcatattgaaagcaattaaaatagtttacctttatttctattgtgatgtactacatattacaatgtgttgaaacattttgatactgtaggaggtcttggacttggaacttttgatgcttgtttaattagtgaagaattggcttatggatgtacaggggttcagactgctattgaaggaaattctttgggggtaagtgacttagaaaattaactacctaactcagctcttgttaatgagatagttactcctgaagaagttggatttttagaagaaaaaaaaaggaaagtcagttactactaggtaaggttagtgggtacacacagttttctttaaagaggaacacaagattcagcagtgaagcctggagttctgatttcgaggcttgataactctggccttgtctctagtactcggagttctgactgtcctttggaggaaactgtatactttggctgcagcttcagtggcaattcttaggtaaagccaagggctaaatccagaattcaggagcaggattgggatggtttgctgccactatggcagtactgaaatttagcaagcaattcttttttttctcactctgtcgcccaggctggagtgtagtagcgcgatcttggctcactgcaacctgcacctcctgggttcaagcaattctcctgcctcagcctcctgagtagctgggattacaagtgcgcaccaccacgcccagctaatttttgtacttttgtttttttttttttttgagacggagtctcactctgttgcccaggctggagtgcagtggcgcgatctcagctcactgcaagctccgcctcccaggttcacgccattctcctgtctcagcctcccaagtaactgggactacaggcgcccgccaccatgcccggctaattttctttttttttttttgtatttttagtagagacggggtgtcaccctgttggccaggatggtctctatctcttgacctcgtaatccgcccacctcggcctcccaaagtgctgggattacaggcgtgagccactgcgcccggcctaacaagcaattcttaggcctgatcatacatactgtgtcacatattctaaacataattttttattagtgcatttcactatagtagattttcacagattataatgccacaggtcctacatataacctaattttatgaaaatacttagattagcagatttatttcctcattctaacttagaggcaaggtataggccagttctttggacttacctgttaggtgaaaaatagttattttttcattttgaattatagcatctctgaatttacatatccaataaaaatgacttgattttttaatgtcaattttcttcggtagcaaatgcctattattattgctggaaatgatcaacaaaagaagaagtatttggggagaatgactgaggagccattgatgtgtgtgagtatgtgtaactgccgctttatttcacacttaagaagggaacaaaggtgctatttctccttttcagtctatatgtatatattgggatatttagcattgaaacaaaacttagcaacatattattacaatgatgtgtcaaggatgccaagaaagtatcataataggccgagggcaatggctcgcacctgtaatcccagcactttgggaggcggaggcgggcagattacttgaggttaggagttcacagcctggctaacgtggtgaaaccccatctctactgaaaatacaaaaattaaccaggcgtgatggcgcctgcctataatcccagctgctcaggaggctgaggcataagaatcgcttgaacccgaaaagtggaagatgcagtgagcagagatcacaccactgcactgctacctgggcgacagagtgagtgagaccctgtctcaaaaaaaaaaaaaaaaaaaaaggtgtcatcataattttgttgcttatttccaggagaagagagatctacttgtgatgtttttgggatgtcaaaaagtgtcataataatcctcttacttcaggagagagagctctatttagtggagcattctacactttaagaactgagtcattgtgtcaggaagttcagattgaatgtagggcaatgtgtgtttgaactagtagtgttttgaattagtaaaaaattaatgttggctggtcgtggtggctcacgcctgtaatcccagcactttgagagtctgaggcaggtggatcacctgaggttaggagttcgagaccagcctagccaaaatggagaaaccccatctctactaaaaatacaaaaattagctggatgtggtggcgcttgccagctacttgggaggctgaggcatgagaatctcttgaacctgggaggcagaggttgctgagtaaagatggcggcactgcactccagcctgggcaacagagtgagactctgtctcaaaaaaaaaaaaaaagcaattaatgtgggctgggcatagtggctcacacctgtaatgtcagcactttgagaggctaaggcaggagaactgcttgagcccgggagttcaagaccagcctgggtaacacagtgagaccctgtctctaaataaataaataaatgaataaataaataaaaattaatgtgaacctgtaactgaagaaatagcaacttatttgttgaatgactgaatgacttgggaagaatagttgtagagtctatttacacctctgaaagcaactcatcacatctctaaatgagatcttttcaacaagataaatacacacacagacatacacacacacacacacacacacacacacacacacacacacacacacacacgctctattctgaaactgttgtttacctaaggatttttacttcttgtttactcaaacatatttcaatctaaggtgtggttgttatactgaaatacagtagatgtattagttttgagctaatgatgagaattcatcttaaagaacagaaaataatatttgaaaataaatgttttttatttcagatacctaaaatttcaagcaaactgtttaataaaggaatttgtacatatttgctaggaaatttgcaattttttttaacaattgagaggttagctaaacattctcactattgtctataagaactgtgtgaaacgtctagattgttctcctgtagcatatacagtcagctctccatatccatgagggaatagtttaggacctgttgccctccatatcaaaatttttggttgccaagtctgttatacaaaatgtacagttagccctttgtatctgtgggttttgctccacagttggttaaattccaaaattcgtggatgccaaaggcaaacttttaaaaaattaaaattttataacttttctaattataaaatactgagtatagaaaatttagaaatgttttaagtagaacaaaaatatctgtaatccctcagatatggagttaattagtattacttccttattgtagtgcctaccacatttttaaatatgtaattgtgtttttaacagttagcccccattatatacatgtagttttatgtacatctttatttaacaacatgaacattttcttatgccttccttctttttacatgctgtaacaatactgcataatttgctatctaatggatatgctataaattgtttcacttttctgtactgttgaatgtttaaactccttgggtttttactttggaaaataatgttatggtaaaaaataatacagaaaaaaaataaataaaaatgatcaaataagaagccaagaacaggccaggcatggtggctcatgcctgtaatcttaacactttgggaagccaaggcaggaggatcgcttgaggccaggagttcaagaccagcctggacaacgttgagagactgccaccacacacacacacaaattatatatatatatatatatatatatatatatatatatatatatatgaaaccaaaaagaagaaaagaagacaaaaacaactctgaggaaccagtagtgacaagccattttgtatagaaaaaaacaggctcatttacttcacaggctctaaaaacttcactgtattatgaaacagacagatgtctaatagcatatttcagggaaaaaaataccttaaaggtggttaaaacaaaattttggtacttaaaaggggcatcttttatggacaactccttaatttgtcatgatgctgaatacatcaaatctccaggtagcagagtaatctagttcagttaacttgagtgacacctgaatcccctctacagaatccctgtcaaaagaccatctggctgacatgtttttatacctcaggtgcctgggaatcaacaccttctgaaacagcatcatttgcgagcatctgttatcattagaaaaatattttggattacataatgcttaagcacagaacctgtcatttttttttttataattttaccagttcatactgtaataggtgttcaataaatgttagagtgatttcactgtacttttctttggctatattgcccttcagatgtttgagtatagttatatttatttatttatttattttttgagacggagtctcgctctgttgcccaggtcggagtgcagtggtgtgatcttggcccactgcaacctctgcctcccaggttcaagcgattctcctgcctcagcctcccaagcagctgggactacaggtgcgtgccaccacgcctgcctaattttttgtatgtttagtagagacaagatttcactgtgttagccaggatggtctctatctcctgacctcatgatctgcccaccttggcctcccaaggtgctggaattacaggtgtgagccaccatgcccagccaagtattgttattattttttttttctgaaatggagtctcgctctgttgcctaggctggagtgcagtggcaccatctcggctcactgcaacctccacctcccaggttcaagcaattcttcctcagcctcccaagtagctgggattacaggcgcccgccaccaagcctggctaagtttttgtatttttagtagagacagggtttcaccatgttggccaggctggtctcgaactcctaacctcaggtgacccacctgcctcggcctcccaaagtgctgggattacaaacctgaagcctcagccaccacgcccggccctaagtaatcatttctagtgcccctatatatgcttactactttgaattaaaatgtatatagtttctttcttttttgttgtatatttttaaaaaataaattgacatgggttctcggcatgttgaccaggctggtcttgaactcctggtctcaagcgatcctcccatctcagcctcacaaaatgctaggattacaggtggggggccaccatgctcggcccagtttctttcttctttggactgtaagtaccttaagggcaagtaacttgtttctttagtatccacagtaccggccactcttgaattaacttgcactaacacttgccttctaccacccccttttatccattactgcttgtgtcttgtcactcctctgtttaagagctctaagaggctcccctgtttctaccagataaaattttaaatttgtaatgtgatataaaagattctcgtcgaccatttccttcctttctttccagactcatgtcttaccattcccttacatgcacagaatttacatactgtggaactctggtactttcagcattagaaacactgggtaactctgtttcttatcttagtgtcatagcatatgccattacttgtacctggaatgcatattcttcctctttttccctcctcgcaaagaagccattttcctttttgagacttaatttaaacatcctctgccctgggaaactagtttctcaagccccttgtctgactttcacacatagagttgcagtatagttatttatcttcactgttacattgtgaaaatctctaggactgaatgtcttttacctctggtttccccatatcctaatttacatcgtggtacatagtagatattcaatacatgtttgcatgaatgaatacatgtgaaattgaatttaatgaacttgtttaaagctatctaacattttcactttttattaaatatatgatttgttgatatacctatgcctaatttgaattatatattaagtgtttttaggccaggcactgtggctcatacctgtagtcccagcactttgggaggctgaggcagaggattgcctgagcccaggaggttgagaccagcctaggcaacacagtgagatgccatgtctacaaaaaatttaaaattagctgggcatggtgatgtgtgcttgcagtctcagctattatacacgggaggctgaggcgggaggatttcctgagtccaggaagccaagactgcattgagcctctgcattccagcctgggcaagagagtgagaccctgtctcttacaaacaaaacagaaaagtttttacatttgagtggtttctttgattttgtaagaacattttaattttagatatttaaaaatatttaaaatacagcttaaaaaataaaacaatcctgtttccaaacagtcaaaatttaatcactaacatttaatttcatttctcttgtttttatatattcaaggcttattgtgtaacagaacctggagcaggctctgatgtagctggtataaagaccaaagcagaaaagaaaggagatgagtatattattaatggtcagaagatgtggataaccaacggaggaaaagctaattggtatgttgttcaaaacatctttgtatattttttcttaattgttttatcttcaaatctctctttctttctgtatatttttaaaccactacagttaaggtatgtttgtggaactggaaggcctaaaggagattataaacagttcagtgattttcaaaaactaattttaagcccctgcactgttttttcaaattaactctcagaagtttaatgtgtaaaataaaatacaaatgcgtgctctgtttgaatctgattaggaaggctagcactctgtctacttggcttattatctccactcctcatctcctataccagccgctccttggaatccctaaaaccctaaggaaaaaggagaacctttggtatagtgcctgtctccagatgtcagaaataaacagagtcagtcttaaaacaggttatctattagagaagacagaatttgactttaataaaatctgaaattttctaatatatggtcaaaaaatatgaagttcaacaaaggatcaaaaataatttgtataaatataaaatactaaaaaaaaacactcgattatttgttgataaaagatgaggaaagttcaataactgttaagttcaataagaatcaatagtatgagcctttaaaaagccaatgtaattttaagccaaagtaatagaagtacagcatcaaatagagaaaaaatggtgacagttctgggcaacacattttaaaacatgtattgaaaaacttgactaaatctagaagcatgtaagtatcttgcattaggaggagcctacaaaacatgttctgaaaagcaaagccttggttattttggaagaatcttgaagtttttcaaatattattacacagaaagatgatcaggcttatatgtttacttcaggatgccagcttagaattaatgagtgaaagttagaaaaatgtagaatttagcttaacataaggacaggctttctatcagcagtgctgttaagttgtcatgggaaatactgtatttacccatcactacaagtatatagagagtttctagaataactttttattgattggaataatgtactaaatgacctgtctctctttgtaaaaaattcagattcaatatatttgtgtgccatatactacagttttctagcaaataaaacatcattttttttcagagtgagcctactaaaaagttacttagattaaacatatcagtcaattccttatgagcatcctaaatatattcagtattatggagtgctatatctttacctttaaccaattcctggtaatatcagcaactaataaaaagtgaagaaactattaaaatttaacaagttgagagaaatctaacaatgcagtttgaagttttcgtaattttaaaaacggattagccaggtgcaatcactcacgtctacaatcccagcagttttggaggctgaggcaggaggattgcttgagcccaggggttcaagaccagcttgggcaacataacgagaccccatctttacaaaattaaaacaaaaagaaagaactgattacaactgttcactgttcatatagtaaggcaaattaggtaatatatgaaaccagataacaatttttacgattttgttactattattaaataaaactatagaatgagtggtaatgtattggttttaaccaaagaaaataagtttgtgttgtttagggaagaatatacctttttaaaagaatttttcgtgtaccaggatatatagaacatgaattagacagatgcttggatatttgcatttttttcttatgttgcacttcaagatctttctgagaaattcttctgtaggaaaaaatcagcaaatattcataataactcagctataacaaaaacactgacttgctgcataaagaaacagtagttggaacatatgggtctccattttatttatttatttttttgagaacatctgccctttaatttgcatttaaaatcagtttctttaaatactttagttacaagttctgaatagtgaagacagagtagtagatgctgcaggcactcagtattggctcccaccccttcccccctccccacccccaggcctcacttcttggctcaagatacaaaaaggcactctctactggccctagtgtcaaatgtcagcagcctcaggcctggatgcagttggatacaaagccatgaatcccagtagctccaaggaattccaatgattgtgcccagatccaccggcaacacatcttagaaatgacctcatccattacaccactatctactaacaccctcagggtggtttcctaccccagtccacgtcctccaaatctgtgtcctgcagaggaagagacaaggccccactataacgcaggaaggaacaagaactgcctcctcagcccacgggcttacagcaacttacttgaaaagctcaaggcaatctgagtctagaggagacctcccttccctaatctctaccaggctctggcccttcttcgggactacgcttggttccactgccatgatgtgctagaatctgctctaagtaagaacaaggtgctagaatgaggcccagcaaccaggaaagggttgctacagccccagctgtgtgagattgtgccaagatgagtcttcttggtgtgagcctatgatggagagcgtgagggcagacctgggctctccttctatgatgattacaacacgtgacctcagggaacctctgctctctcctcccattcacacacccagatcccctggcctgtgcttcctggtagaggtagaagaggcatcttgaagtcaatgacaatggagaatgaaggtgccattgaagaaggaaagcagcacctctttgcctgtgttcaatccctccatacaagtggaatcgagaatgtgcacagccaggacagaggctgctctgagcttgggaggcacagcatcctcctagatgtctctgcagaacaaactttcaaaagataggaacttaatcacatggtcctcgggggtttctctatagtataccagcactagggagaagcaaaatcatctttgcagagagctgatggaagaaaggcaggaatatgaatgagcatccattaaggctctctctcaagcctaaggaattaagatattcgagggtatgagacaggtgcagagagggagagagccaggcaggaacaccaagaaaaaagctgtgactgctggttacatagtgctctgcttccttgcttgaggccaacagcatgtgcctgtcaccaggctaacctgggacccatgaggggacagggagaagactggttttcagttcctgcatgatcaatttgtagggtgtgtgggttcctcctaaagatcaaagaggaggactctgggatcctctaccgctgccttgattttgcggaggaaagtcacagcctctctgccatcaatcagccggtgatcataggtcagtgccacgtacatcatgggctgcacctctaccttgcctcctatagccactggcttgtcaaagatgccatgcatccccaggatggcagacaggggggttgataatgggtgttcaaagagtgagccaaaaacacctccattgctaatggtgaaggtaccaccatccatatcttcaatggcaaattcattctttcgggccttctctcccagttcagtgatggtctgttcaatatctgcataattcatagcttccacattcctgatgactggaaccaccagaccctgtggggtggccactgcaacactgatgtcaatataatccctatataccacctctttggttatatcatcaatcactgcgtttacaacaggctgttcctgcaaggcaaaggctgaggccttcacagatgccgacatgaagcctagtttgaggttatgtttcttcaaaaaagcctctttgtgccgagccctcatcttctggatgttactcacatcaatctcattaaaaattgtcagcattggcacatgtattctgggcctccttcagacgctgagcaatgcactgccgcatcctgttcattttctcctgatgttctgaatgcagacctttgccagctcctggctcagctagtggtgggacagcagtgggttttactgcagacacaggtttgctagaaggaggttgtgagggcgagggcactggtggcatcgagtgggtatgggtgctgcatggggaggaactgccgctgctataggttctgcttttggggctgcagcagcaggagcttcagccggcttggccttagcaggagcagcaccagttttcctgagtgtgaaaagcggagtgcctccttcgacttttcccccatcaggtacgaaaagagcttcaatcatgccatttgctggtgatggaacctgcaccaatgtcttgtcagtttcaatctcacaaaccacttcatcttctgcaactgtgtctccaacagctttctcccacctgacatctccctctgtgacaggttctgcaaacgctggggttttgactgtaaccaagtcatacttgcatacagttgtagttctgaagaagcgaacactgaagacactgttgttaatgacaaccttcctgctgttagggtaacctggtccctggcataaggagaccccaggcagggaatgtctccctagagggcagttccccttctggaaggcagagagcgagtggctgaacgcccgggacacagtgggaccgggacagcatcacggcggccgggtctccgttttatattattccttttcacaggcagctctatttgccctccttttcaagatagcatgccccttaaagaataaaattagttttgggaaagaaaaagtgccagtttcaacaggcatagactgtcttgttgtaataataatactataccaggaatttttacttgcaactcatattactaaaagaaagttaaatagcatactatagtccctccttatccttgcaggatacattccaggacccctaatggatgcctgaaacctcagaaataccaaaccctgtatatactatgtttttttcctacacatatatacttattataaagtttaatctataaagtgggcccagcaagagattaacaacaactaataaaatagaactataacaatgtattgtaataagttatgtaaatgtaggccaggcatggtggctcacacctgtaatcccagcactttagaaggcccacgtgggaagatcccttgagtccaagagtttgagaccagcctgggaaaggtagtgagacttcatccctacaaaaaataaacaaaaaattagctaggcatggtggcacatgcccatagtaccagtgactcagaagaggtggaaggatggcttgagctggggaagtcgagactgcagtgagccaagatcatgccactgtactccagcctgcgcaacagagtgagatcttgtctaaaaaaaaaaagttatgtaaatgtcctctttgtctttcaaaatatcatatatatactgtactgcgggtaactgaaaccacagaaagtgaaaccccatggaatgggggagggcctactgtgttattaagacatagacctcaaatactagctcttccatatactaggtacgtgactaggcaagtttttaaacctgattatttatttcctcatttgtaaaatgtaggtaataataattgggattgttaagagaattaactgagagagcaatcaccatgtgttatttgccgatattatcaccattatccggtatgtgtatctcttaggtattttttattggcacgttctgatccagatcctaaagctcctgctaataaagcctttactggattcattgtggaagcagataccccaggaattcagattgggagaaaggtaaagtatttattaatgattagggccccaaatattattttaattataaattgcaaaattacttaactttcctttaataaaaacatttgtttgtattaagttggagtaaaaataaagctatgttttgatgatattagatcaaatagtctatatactactgaagattttgtgaacagtcatttcaagtcattttgaaagagtagtaccaacctgtggagaaggctaataacagctgtgaggaataatgaagtaaaatcaagctatcatttatattacctgaccaataataagaattctggatatttcaagggactttcccactcttttccccattggatcctcacagcaaccttttggtaggataagtggcattatgcccattttacagataaaaacaatgtgacataactgagattttactaggtcatacaacactaagaaaaaagtctatgcctgaaaagagtgtagaaaatagcaaatagccttgaatatggaaaggcaagaaaatcttacttaaataagaaaaggtaatttaacatatttgaaaaggtttgtattctgaatatgtggagataaatttggcatttaaagtagactaaagagaaaagagtttaaaattttataaatcacaatttaaaattataaattttataaagaaggaaagaaatgaagtcaataaagtaattttttttttttttttttgagacagcgtctcgctctgttgcccaggctggagtgcagtggcaggatctcagctcactgcaacctctgcctcctgggctcaaacaatcatcccacctcagcctcctgagtggctaggattattggcatgcaccaccacacctggctaatttttgtattttttgtagagacagggttgtgctgtgttgcccaggctggtctcagactcctgggctcaagcaatcctcccaccttggccccctaaagtgctgggattacaggcatgagccactgcgcccaaccaaagtcccaaagttagaggcagagttgaaatcaatatgaaggtatcctaggaccttacccagtatagtttctgatactgtattgtgctatattttcaatcagatattaaaggtagactgcacttgacaaaacagatgatactgttgtatgtaacaaaatataagaattaaaaattattgtgcttttcccaagaaattgttttttatttgtataacagatcatgtttctgtcttagggatagttgctagcaaacttggccaaatgtatggcccatctttagaaagtataaaggacctaacagcttatactttttttagtagtaaactcactcctgattttatcttgctatttctagtttttttctttgcctaattttctcacttaaaaaaaaatctacttcaataaatatttatgtagtgcatactatatacagtattctatctattagggatacagtatggatcaaaatagacaaaaatccctggccttaggtaaattactttctggtgagtgatagagataattatattgtgtatatttaagcctccttaaatctttattgaaacaaatggatatttacaaatttgtgaaatttaatgttttcaggccaggtttggtggttcatgactgtaatcctagcactttgggaggttgaggtgggagaactatttgaacccaggagttcaggaccagcctgggcaacatattgagactttacctctacaaaaaaatttgaaaattagccagtggcagtggcgcacacctgtagtcccagctacttggaaggctgaagtgggaggatcacctaagcccaggaagtcaaggctgcagtgagccatgctcctgttgctgtctgtactgcagcctggatgacagagtgagacctaatgttttcaaatcttttgtgttttagaaattatatggtttgagatgagcccaggaagcattttggttttaaatgttgtggggtttgggataaatctggtagggtgttttctcattatatatgcatggtggtccaagattctagtttattaacttttaaagacaaaataaagggatgttggcttctttctaggtcaaactatcgttattatttcttcaaactcagaagcagactattaaaaccagcaaattaaagggttagtttatagctctttgtttccattgctcctgtttcttattctgcttattaaacatgagatcaagtttttttccttattaagagttatgtctgcaacttcctctcatgatttagcataacactaatagtcatatacaaagagaaagagaaataaaaaataaagcaaatgtatcaaaatgttaacaattggtgaatctattatagatgaagggtgtataagtacttacatgcctgttacaactcctccattggtttgaaaatttttaaaacaaaaagttgagggaatgtagctagtttagtagtttcttataaagtcaaacatacacttatcacataaccagtgcccttaaataaatacccaagagaaatgaaaataaagacctatatacaaatgtttattgtaattttattaatgattgctaaaaaggaggggagtatccgtcaactagtgaaaagataatggatatatggtacatccaagagtgggatactacttagcagtaaaataaatgaattattgatcatgcagcaacatggatgaatctcagaagcactatactaagtgaaaagtcagacacagaaagcggactttattatttcacttaaatgacattctggaaaaggaaagactacgcggagagaaatcacacagtggttgccaggggataagtgtagaataaggaaattgactataaagggagaacaaggtaactttttggggttctaaagtactctgtatcttgagcatggtggtggttacacacatatacatttgtcagagctattagaaatgtatacataaaaatggtgacttttctacatgtaaattatacctcagtaaacctaattttaacagagtcaaaggaaaacaaaatcaatttttattcagtagattattttactagctctattaagattaaaggtctcaaatcagattgtgtttactaaatgttttttctgacatggtaaaatagatagctttcaaacatataatgagatttgtctttgttgataagatgtacttgtagacctttagactagtgttggtttcaaaatttgtgaaacattgttttagattatggttggcaaatttttttgtaaagatccaaattataaatatttcaggctttgcaggccatatctctgtcacaactactcagttctgccattgtagcaagaaagtaactgtagatgatatatgaacaaataggcgtgactgtattccaatcaggctttctttgcaaaacaggcattgcagactacagtttgttgatccctgttttaggtaattgcagaaagtcatgaaacagtgattaaagcaaaaattgatgctggctcaaaaaaaattccttaaaatatatcaattttcttattaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtaagtaatatgggttcataatctttataggatcttttatttattacattaaataagtatttttactttaaaattgtatgttcagtgtgtttctctttttaatatctgcttattttattaaggatataggaaaaatactgttacttttctttcttttttttttttttttttgagacagagtctcactctgtcaccaggatggagtgcagtggtgcaatctcagctcattgcaaccttcacgtcctgggttcaagagattctcctgccttagcctcatgagtagctgggactacaggtgcacaccactctgcccagctaatttttgtatttttagtagagatggggtttcatgatgttggccaggatggtctcgatctcttgacctcgtgatctgcctacctcggcctcccaaagtgctgggattacaggcgtgagccaccgcgcctgaccatattgttacttttcttaattttttaaataattcttcaagttttcttactatacattatagaaattattttagcaactgcaaaattactgtagttggtgctagatttagagaggcagtccaccctaaatatgatcatcctgttaatatgtactcattttctgtttttactcattaagaacatttcccctagtaagatttctcttgttaaacaaaagcaatgacttttttctagagtatgatactatgcctaacaaatgcctcttactacctttaattaacaaataatataaacttacgtgcctattccctgttccccaccagtttcttgttgctgtacatcaccttctctttgtacactccctaacatagacacttaggcagatattgtgtgttttaaagataacatgaacttttgctttataatatcttaaaatactaggtagctgctggtgctgttggattagcacaaagagctttggatgaagctaccaagtatgccctggaaaggaaaactttcggaaagctacttgtagaggtaattttaatactgcttgctttgttcaaatgtaaagacactcattttcatttaatatttagaaatgatttttaaaccacaaactaatcaatttctactttgatagcaagaagataatgtggttttatcaagatgagtttcaaagacatttctttttagagtgtgccactattggttacttctgaacctgacactgtgctatgcatttttttttttttttgagatggagtctcgctctgttgctcaggctagagtgcagtggcacaatctcggttcaccacagtctccgcctcccgagttcgagtaattctcctgcctcagcctcccaagtagtgggaactacaggtgcgcaccactatgcctggctaatttttgtatttttagtagagatggggtttcactatgttggccaggctggtctcgatctgcccgcctcagcctcccatagtgctgggattacaggcatgagccactgggcccggccttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactccagcctgggcaacagagtgagactccgtctcaaaaaagaaaatatatatatattttctgattctctcagtaacccttttttgggtggtgttatctcttttaaggatcaagaaactgaagctcagaggtattaaatgatttgtccaaggccacacaatttataagtcacagatccaggatccttgcttttttttttttgcggggggtgggagacaaagtcttgctctgtcgtccaagctgaagtacagtggcatgatctgggctcactgaaacccccacctcctgtgttcaagtgattctcctgcctcagcctcccgagtcgctgggactacaggcacacaccaccacacccagcaaattttgatatttttagtagagatggggttcccttatgttggccaggctggtgttgaactcctggcctcaagtgatctgcctgcctcggcctcccaaagtgctaggattacagacctgaaccactgcgcctggcctatgttatactcttaattcttgttacttcccatgtcctcttgagtatcagataattttagtactataaagagtcgtgtcttccatgaatttccagggtaattcttaactcttacccctttaaatattgatgctcccccattatctgtattctttcctgcaactcactatgagttgtatagtgaacctcctatttctctttttttttttttttttgagacagggtcttggttgcccaaatgcgagtgcaatggtgcagtcatggcttattgcagcctcttgggatcaagcaatcctcccacctcagcctcctaaataactggaactataggggcacactaccatgcctgcctaatttttttatttttgtagagatggggtctcactatgttgcccagactggtctcaaacacctgagctcaagcaatctttccacctcagccccccatgagcctcctattcctatctccatttgtcagtggttctcaaactatttgtggtgaaagaccagtttgttttaatttccagttaatgtggaccattatttttgtaaaatataagaatgtcacaacaatgttaaattgctgtaaaagtgtctaaatgcttattctcatcttctgtaccatcaaccagtaacagtttgtgaattggcactgtggacaaacttggattagcactgctctgtgtcccttaaccttagtttcataatgtatctttctacactatattctagataattttttcagatctgctttctagttctcttatcttgtgcctaatctatttaatctgttgattttttattaatgactacttttcatttccagaagttatatttggttttttccattataccttctgttcaacatcataccgccttttccttttttctcattaatcatgtaaaaattcttcatttataatcaatttcagatttttttgttatcttcaattctttgggtgctaatctttcaaggtgtattgtgtcttctaactcttttatggtcaattattttgcttttattttttatttgtaaacaacttacctgcaggaagtactctatttctcagagcattatggaagcattttagaaattggcttttgtacttttttggcacttttgttaggtactccagagatttcaccattctaagagctgttattttacattaatttcttgacttggagaatcctgtatcacagagctcgtacattgatctcacacattaagaaactccgtacattccagtctgggcaacagtgtgagaccctgtctcaaaacaacaacaataacaaaagtccttttttttcttgttctttttttaaccctcctgggcaagagatcagcttctttgtggccctcctatgctgatgagcccagacttttaattgcccctttggaaagcaaagcttttacatgcagtgattctcagttttagccccttagattgttcatgctcacatcgaaatctcctgttcttatgtgtttcttaaaactctggttcctatcctgctgagcccaaatctgagtctgatttttcttttcctccatgttatctcttctcaggatttaaattcctttttagaggcacttagagatttctgtttctttcctatgagctttttttttttcttaaccaagtatttctttgttaactccttcatgttgccagaactacatatgtacattttactaaatgttagtttatcttattcataaacaaatttcaacctaatgcttttcagtgaagatctgtcatcgtcttccaggtcctccttacccaagtatctgatgataactgtatttttggctttcaactcaatatagaatcttctccttttatgttctctttcttataaattctaaagatttttttcttattaaatattgaaaaatcttagtttttccttactgcttaactcaaaatagtcttttatcatttgatttctactgaagatttgcttatcttttaagcactctgcaaaatgctgatagcttcttttttttttttttttttgagacagggtctcactctattgcccaggctggagtgcaatggtgtgatctcagctcactgcaaccactgcctcctggcttaagtgatcctcctaccttagcctcctgagtagctggaactataggtgtgagccaccatgctcagcttttttttttttttttgtagaaatggggttttgccatgttacctaggctggtctcgaactcctgagcttgagtaatccgcccatcttggtctcccaaagtgctgggattacaggcatgagtgactgcgcctggcctagtttttcatttttaattggtaggtacagtgatatgacactgtaattccttgtcactcctttgctaggtgtctctcaacccatttgtgtgccctttgaaacttcagttttttgttttttttttttttttgagacggagtcttactctgttgcccaggctggagtgcagtggtgcgatctctgctccctgcaacctctgcccccggggttcaagtgattctcctgcctcagcctcccgagtagctgggtttacaggcgcccgcaactgcacccggctaattttcttttgtacttttagtagagatgaggtttcaccatcttggccaggctggtcttaaactcctgaccttgtgatccacccaccttggcctcccagtgttgggattacaggcgtgagccaccgtgtccagccacttgtctttcagtctgtgtactctatgtatagcattatgaatgaaaagggtcaggttattcttggaatccacaattaaataattgtttagccatttcatgtgtggtattagaaaatatacaatgatctgcccaagggttccaagatggctgaataggaacaactccagtctacaggtcccagcgtgagtgacgcagaagacgggtgatttctgcatttccagctgaggtaccgggttcatctcactgggatttgtcgtacagtgggcgcagcccacagagcatgagccgaagcagggcaggtcatcacctcacccaggaagcgcaaggggtcggggaattccctttcctagctaagggaaactgtgacagatggtacctggaaaactaggacactcccaccctaatactgcgcttttccaacagtcttagcaaacaacacaccaggagattatatcctgcgcctggcttggagggtcccacacccatggaacctcacccactgctagcacagcagtctgagatgaaactacaaggcggcagcaaggctgagggaggggcatccgccattgctgaggcttgagtaggtaaacaaagtggccgggaagctcgaactgggtggagcccactgcagctcaaggaggcctgcttgttgctgtagactcccctctgggggcagggcatagctgaacaaaaggcagcagaaacttctgcagacttaaacctccctgtctgaaagctttgaagagagtagtggtcctcccagaatggagtttgagatctgagaacagacagactgcctcctcaagtgggtccctgacccctgagtagcctaactgggagagacctcccagtaggggccgattgacacctcatacgtccgggtgcccctctgagacgaagcttccagaggaacaatcaggcagcaatgtttgccattctgcaatatttgcagttctgcagcctctgctggtgatacccaggcaaagagggtctggagtggacctccagcaaactccaacagacctgcagctgagggtcctgactgatagaaggaaaactaacaaacagaaaggacattcacaccaaaaccgcatctgtacgtcaccatcaccaaagaccaaaggtagataaacccacaaagatggggagaaaccagagcagaaaagctgaaaattctacaaatcaagagtgcctcttctcctccaaaggaatgcagctcctcgccagcaacggaagaaagctggatggagaatgacgagttgagagaagaaggcttcagatgattggtaataacaaacttctccgagctaaaggaggatactggcaaactgaatccagcagcacatcaaaaagcttatccaccacgatcaagtcagctttctccctgggatgcaaggctgattcaacataccttgaatcaataaatgtaatccatcacatacagaaccaacgacaaaaacttatgattatctcaatagatgcagaaaaggccttcagcaaaattcaacagttcttcatgctaaaaactcaataaactaggtattgatggaatgtatctcaaaataatagctatttatgacaaacccacagccaatatcatactgaatgggcaaaatctggaagaattccctttgaaaactggcacaagacagggataccttctctcaccactcctcttcaacatagtgttggaagctctggccagggcagtcaggcaagagaaggaaataaagggtattcagttaggaaaagaggaagtcaaattgtccctgtttgcacatgtcatgattgtttatttagaaaaccccatcatatcatcccaaaatctccttaagcagataagcaacttcagcaaagtctctggatacaaaatcaatgtgcaaaaatcacaagcattcctatacaccaacaacacacagagagccaaatcatgagtgaactcccattcacaattgcttcaaagagaataaaatacctaggaatacaacttacaagggatgtgaaggacctcttcaaggagaaccacaaaccaccactcaatgaaataaaagaggacacaaacaagtggaagaacattccatgctcatgggtaggaagaatcaatatcgtgaaaatggccatattgcccaaggtaatttatagattcagtgccatccccttcaagctaccaatgactttcttcacagaattggaaaaaactactttaaagttcatatggaaccaaaaaagcccacattgcccagacaatcctaagccaaaacaacaaagatggatgcatcatgctacctgacttcaaactatactacaaggctacagtaaccaaaacagcatggtactggtaccaaaacagatatatagacaaatggaacagaatagagcccttggaaataataccacatgtctacaaccatctgatctttgacaaacctgacaaacacaagaaatgggggaaggattccctatttaataaatggtgctgggaaaactggctagccatatgtagaaagctgaaactggatcccttccttaccttatataaaaattaattcaagatggattaaagacttaaatgttagacctaaaaccataagaaccctagaagaaaacctaggcagtaccattcaggacatagacatgggcaaggacttcatgtctaaaacaccagaagcaatggaaacaaaagccaaaattgacaattgggatctaattaaactcaagagtttctgcacagcaaaagaaactaccatcagagtgaacaggcaacctacagaatgggagaaaatttttataatctacccatctgacaaagggctaatatccagaatctacaatgaactcaaacaaatttacaagaaaaaaatcaaccctatcaaaaagtgggtgaaggatatgaacagacacttctcaaaagaagacatttatgcatccaacagacacatgaaaaaatgctcatcatcactggccatcagagaaatgcaaatcaaaaccacaatgagataccatctcatatcatttagaatggcaatcattaaaaagtcaggaaacaacaggtgctggagaggatgtggagaaataggaatacttttacactgttggtgggactgtaaactagttcaaccattgtggaagacagtgtggcaatttctcaaggatctagaactagaaatgccatttgacccagcaatcccattactgggtatatacccaaaggattataaatcatgctgctataaagacttctatgaccaaagatgtaggaggatttcccacccacaccaagcaacagacactagctgggtatcctccaacttagttctgacactacctacccagagatagcatcagatcccacaggcttagtctcacaagactgccccttcttttcccctagttgcaagtcctggactccagaacttctggctgactggcttcaagttggggttcccatgacctcatctgtgaattccagtaatttgctaaagcagctcacagaactcagggaaacacatttaccagtttattaggaaggatatctaatttttttactttttttttaattattatttttttcatacagagtctccctcttgttgcccaggctggagtgtaatggcgtaatcttggctcactgcaacctctgcctcctgggttcaattgattctcctccctcagcctcccacatagctgggattacaggcacctgccaccatgcctggcctttttttgtttgtttgttttttaagtagagacagggtttcatcatgttggccaggctggtctcaaactcctgacctcaggtgatccacccaccttggcgtcccaaagtgctgggattacaggtgtgagccaccacgcccagccaggaaggatattttaaaggatacagatgaagagatgtgcagggtaaggtatgagggaagatgcatatggcttccatgctctccctgggaatctcaccctgtaggaacctctggaagctctccaaaccctgtcctcttgagaggtgaagccagctggacttcctgggtcgagtggggacttggaggacttgtctgtctagctagatgattgtaaacacaccaatcagcactctgtaaaaatgcactaatcagcactctctgtctagctaaaggattgtaaacacaccaatcagtgctctgtaaaaatgcaccaatcagtgctgtgtctagctaaaggattgtaaactcaccaatcagcactgtgtaaaaatgcacgaatcagcgctctgtgtctagctaaaggattgtaaatgcaccagtcagcactctgtaaaatggaccaaccagcactctgtaaaatggaccaatcagcaggatatgggtggggacaaataagggaataaaaactggccaccccagcctgcagcggcaacctgctttggtccctttccacgctgtggaagctttgttcttttgctcttcacaataaatcttgctgctgcttactctttgggtccacaccacctttaagagctgtaacacttgccacggaggtccgcggcttcattcctgaagtcagcaagaccacgaacccactggaaggaagaaactctggacacatctgaaggaacaaactccagacacaccatctttaagagctgtaacaccgcgaaggtctgtggcttcattcttgaagtcagcaagaccaagaacccactggaaggaaccaactctggacacactcttgggtgttcatggaggcttcattacataggcatgattaattaaaccattggtcattgatgatttaacttgacttgtagcccctctcccctccctggaggttgtagggttggggctgaaactcccaaccctctaatcctgccatcgtctttccagtgaccagcaccacgctgaacctagcagacaaaagacagcacgttggagatcccaaggaatttaggagttgtatgccagggaacaggaacatatttccatcctataacatatcttggccatataactaactcatagagcacttactatcccttattgaaagtatttgttttatgtcttctatttaattctgagcctctagagtctaagaagcatcttttagttgtcctttcctctgtcttggtatctgatacagtgccacattatttttctctatctgtagcaactttctttttttttttttttttttttttgagacagagttttgcttttgttgcccaggctggagtgcaatggtgtgatcttggctcaccacaacctccacctcccaggtttaagcgattcttctgcctcagcctcctgagtagctggtattacaagcatgtgccaccatgcctggctaattttgtatttttagtagagacggggtttatccatgttggtcaggctcgtctcaaactcccaacctcaggtgatctgcccgcctcggcctctcaaagtgctgggattacaggtgtaagcccctgtgcccagccagcaatttcttctagaaagtcccagcagaggctgggtatggtgaatcacacctgtaatcctagcattttgggaggccgaggtgggtggatcccttgagcccaggagtttgagaacagcctggaacagcctgggcaacatagggagggacctcatctctatttaaaaagaaaaaaaagaggccgagtgcggtggctcacacctgtaatcctagcactttgggaggctgaggcgggtggatcacctgcgatcaggagtttgagcagcctggccaacatggtgaaaccctgtctctactaaaaatacaaaaaaaaaaaaaaaaaaagcctggtgtggtggcacacgcccagctactcgggaggctgaggcaggaaaatcgcttgaacctggggggcagaggttgcagtgagccgataacgcaccacttcaccccagcctgggcaaaagagtgaaactttgtctcagaaaaaaaaaaagtcccagctactttgggggctgaggcgggagggtcgttgaggctgcagtgatctgagatcatgccattgcattccagcctggaaaacaaagtgagaccctgtctcaaaaaaaaaaaaaaaaaaaaaaaaaaaaaaaaaaaatcaggcaaactgaaattgaaggacattttacataaaataaccaatcaacattcttcagaagtgcaaagacgtaaaagataaggaaggattgaggaattataatagcctgggaaagaataagaagaaataactaaattcaacgtataatggtggaaaaagaacattagtagaaaacttgaccagatttgagtaaggcttatagtttagttgttaatactataccagtgttaatgtcctgttctcgatcatggcactatggtttggtaatatgttaacattagaggaagctgggtgtaacttctataaacctaaaattcgttaatgaaaagtttaaaaaataaaaaggtcaggcacagtggctcacgcctgtaatctcagcactttgagaggcctaagtaggaggattgcttgaggccaggagttgcagaccagcctgggcaacatagcaagaccccgtcactataaaaatgaaaaagccccaggaaaaaacttttaagttttctcaataaatatcctttaatttttttctttttaattctagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcaggtaaggttaaagatgatttttttggtttgcaaggagagagaatattcataaatgacaacgtggatttctgattatttagaaattttatgtccctagtagcaataaatgactgtcatatatggctgtgagccagtttttggaattaattaatagaaagaagaatgttatttgtgattaagtataagtctgaagagagaataggctaaaaaaaatggtacagacatgtgtattacgtttggattagatttctttgagttttaacagattggctaattgtaacccaaacttttctctccaaaaagtatgcatgtcatttaaaattaattattttgatttgaatcttgcctgacaactatttaatttattgtaactatacttggagtcaaaaaccaacatcaggagacagtgatgtagattaattccaaattaaattggtagtcaaaaaaacttaggaggaattcagtaaaaggaaatataaatgtgcatgttctctacatgtggcttaagtaattacttaataattaccacattcttgctcctcagtatctcttcccttgttccccctacacctagcaaattatttgactcatccagtcattggaaatactgagttcgaatcaaaatgctggagtgagaaggaatgttacacgtagtgcagcctctccatgtagacatgaaaaaactgaggtccagaatttgtgccttatccaaagtcacaggtttatgtggtgatactcttcctctcctagagcctttaattataattattactattattatcatcaacagtttagcttttctctgccatctgagaagatgaactaacgaatggctaaagttagaagtttagaatggaaataaggtctgactcttgaaatccttccagcatctttttctttagcaactctgttccacaggcagtgggagaaaaaaaaaaaattaagggtaagaataaaagactgaaggagacagctagctaagaacagttcagaaaattagacaaatattttggccacattaaactttagttttcccaaactttctgaaatgtaaatatcttttctttttttatattttgaagactcttctccaaaattttgataaatggctttttataataacttaaccaatctttagagaattccatattttcagactttcacaaaatcaggttttggaatctgtagaggctacagaccctatatatggtttgattcggttttatattacaacacagcttatgctactgtctaaaatgttgaataaatcaaagtatttatgtactaaagatatttaacctacacttatatttttcttgcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagacctcagaaaatataaatatgaaataatttaagaacccaaatctctgaatttaatatttctttgtaattctaaatatcgaatactgctaaactgtgttatactaaatggagtgctttctgacatcacatctcattctctagttctttgacatcaactgtgtcctacattttaattctgttctgacactatgcagcagagttagggtcaaccccataaggctgccctcacttcagaggccagtcacaagtcctgactccccaagctacccatactctgtccaacatggctacaaattcaggtattcccatgaccctgccctcagggtcgataatttgccagaatagctcacagaactcaggaaaacacttaacttacatttacctgtttatatcagaaagggtacaactaggaacaattaatgaagaggtgcatagggaaaggtatggagggagaagggaggtgcagagcttccatgccttcttccagcatattaccttccctgcatgtctctgtattcctcaacgtggaagctccccagctcaaattcaatagtttccatggagctcaatctccagtcctccactcctccccagaggaccaaggtgaaagctggaagctcccaactgtattagtctcctagggctgtcataaaaaatacactggagacttggtagcttaaataaatttattttctcacagttctggaagctagaatttcaagatcaaggtgccatttgggttgtttctagtgaggcctctcttcctgccttatagactgccaccttctgtgtccttacatgtcctcttctctgtgcatcatgaagggttgggttagggggagctcttgtgtctttttctcctcttctaaggacactagccctgtgagattagagtcctatcctcatgaccttaattaactccctaaaagatcctatcttcaagtacagtcacattgggagttaaggcttcaacataggaattttggagggacacaactcagtccataacatcaccctctaattacttagtccttctggtgaccagattcctcctgagattatctaggggccccaccctaagtcatctcatgccaaattcaggtatgattgaaaaggtttataaggaataacagaagataactccaagaactcaagaaattccaagggttttaggagctctgtgccaggaacaaagacctgggaacaaagaccaaataaatttcttataccacattaaattaccaaaataatcgaatttcttacaaatataaaatatttaaatgacatttccttcatgctcaatgatgaaattttatttaaatgatacaacttgagattggtaaggagatttagagaattcttaattgggtattatgtagaaatgagaagttaaatagaatgtatatatttcaaatgcaaatttgaatttgcagtacagaggcccaaccatttctaaacataaagcttctagacatgggctgggcatggtggctcgtgcctataatcccaacactttgggaggttctgaggtgggaggatcactgagggcaggaatttgaggcttcagtgaactgtgatggcaccatttatactccatcctgggtgacagagtgagaccctaaaaagaaaaaaaaggtccaggcaaggtggctcatgcctgtaatcccagcactttgggatgccgaggcgggcagatcacaaggtcaggagtttgagaccagcctggccaacataatgaaacccggtctctactaaaaatacaaaaaattagccgggcgtggtggtgagcacctgtaattcgagctacttaggaggtgaggcaggagaaacgcttgaacccgggaggccgaggttgcagtg

SEQ ID NO: 11744 - DNA, 87869 bp, Human
ataatttattgtaccacatttatttatttatttatttatttatttatttatttatttatttatttttattttttgagacatagtttcgctcttgttgcccaggctggaatgcaatggcgcaatctcggttcactgcaacctctgccttccaggctcaagcaattctgcctcagcctcccaagtagctgggattacaggcatgcgccaccacgcctggctaactttttttgtatttttagtagagacggggtttctccatgttgatcaggctggtctcgaactcctgacctcagatgagccgcccaccttggcctcccaaagtgctggaattacaggcgtgagccaccgcaccctgcctattgtaccatatttagtttcccaattttttgctatataatattccatgaatatctttgcccaaaatttttgtagattgtttctaagaatagttcatcagcattttaagacatcctattaatattagcggactgcaatcagattgaagtagttcacaaatagatgggttttagcctgtatttgttcaatactgaactattgtatgtatcaggcactgttatgtatcaggcactgttctcagcacttgtaaaatgtatatgtgctgctgacaagcatgagcacttgtaaatgaacaaactaaaatccctactcttgttaaagtgggggaggtgaagaattttaaaaacatcttttttcgttcaaccttctcccacaacttatctttcattctgctaatggaaaatattacttttgttcttaaatatgaagcttttgtgtgtaaaaagtattagaatctcatgtttttgaacaaggttggcagtgggttgggaggagggattggagattgatgcgataggaatgtgaagggatagcttggggtggattttattttttaattttaatttttattttttgagatggagtcttgctctgtctcccaggctggagtgcagtggtgtgatctcagctcacgggttcaagcgattctcctgctgcagcctcccgagtagctgggattacaggagcgcgccaccacacccggctaatttttttgtatttttagtagagacggggtttcaccatgttggttaggctggtctagaactcccaacctcatgatccgcctgcttcggcctcccaaagtgccggaattacaggcgtgagcgactgcacccggccgcttgggggtggatttttaaagaaactttagaagaatgtaacttgcccagataccatgtaccgttaatttcattttcggttttttgaatacccatgtttgacatttctccgttcaccttgattaaataaggtagtattcattttttagttttagcttttggatatatgtgtaagtgtggtatgctgtctaatgaattagacattggtactgtctttaccaaaactggacaaagagcaggcagatgcaaaaatcaagtgacccagcaaaccagacacattttctgctctcagctagcttgccacctagaaagactggttgtcaaagttggagtccaagaatcgcggaggatgtttaaaatgcagtttctcaggttctcgccacccaccagaagttttgattcattgagtggtgggagagggcagagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggccaggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatgtgcgtgatggggagtccgggcaagccaggaaggcaccgcggacatgggcggccgcgggcagggcccggccctttgtggccgcccgggccgcgaagccggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcaggtgagatgtgattagagttcgatctgcggtggtggcagaggcttacaagaaacactaacgggacatgggaaccaattgaggatcagggaataaagtgtgaagttgactaggaggttttcagtttagaacatggcagagacattctcagaaataaggaagttaggaagaaagacctggtttagagaggagggcgaggaagtggtttggaagtgtcactttggaagtgccagcaggtgaaaatgccctgtgaacaggactggagctgaaaacaggaatcaattccatagatttccagttgatgttggagcagtggagaagtctaagctaaggaaggggaagaggaggccaaggcaaacacttaggaacacttgcaacgagggggtggaagaagagcaaggagccagctgaggagaatgagtgtggttggagaaccaccacagcgcagggtcgccagagctgaggaaggggagggaagcttcaggaaggaaaaggttggcagggattttgagtgttaggcctggtgtagcagaaggaacagaagatttagagcagcgctagccaatagaaataaaatgtgaggcccggggcggtggctcacgcctgtaatcccagcactttgggaggccgcggggcggatccttgagctcaggagttcgagaccagacaacacggcgaaaccccggctctacaaaaaattagctgggcgtgggggcgcgcgcctgtagtcccagctgctcccaagcgaggctgaggcaggagaatcacttgaacccgggagaaggaggttgcagtaagccaagattatgccactgcactgcagcctgggcaaaagagtgagactgtctcaaaaaaaaaaaaaacctgttttgtttttcttttggagaaaaggcatacaaatttattagcatgcagactgggagaaccacaaggtgattatccctattttaaattttctaataaacatactattatttatttatttatttatttatttatttatttattttttgagacggagtctggctctgtcgcccaggctggagtgcagtggcgcgatctcagctcactgcaagctccgcctcccgggttcacgccattctcctgcctcatcctccccagcagctgggactacaggcgtccgccaccacgcccggctaatttttttgtatttttagtagacacggggtttcaccgtgttagccagtatggtctcgatctcctgacctcgtgatccgcccgcctcggcctcccagagtgctgcgattacaggcgtgagccaccctgcccggccggctatttatttttttagagatgggagcctcactatgttgcccaggctggtcttgaactcctggagtcaagtgatcctcccgccttggcctcccagagtggtgggatacaggcacaagccactgtgcctagccataaacacatttttaaaggtaaaaaaaggccgagcgcggtggctcacccctgtaatcccagcactttgggaggccgtggcgggcggatcatgaggtcaggagatcgagacatcctggctaacacggtgaaaccccatctctactaaaaaatacaaaaaaaaaaaaattagccgggcgtgatggcgggcgcctgtagtcccagctactcgggaggctgaggcaggagaatggcgtgaacccgggaggcggagcttgcagtgagcggagatcgcgccactgcactccagcctgggcgacagagccagactctgtcaagaaaaaaagaaaaaaaatgtaaaaagaggctgggtggccgggcgcagcggctcacgcctgtaaacccagcactttgggaggccgaggcgggtggataaccagatcaggagatggagaccatcctggctcacgcggtgaaaccccgtctctactaaaagtacaaaaaattagccagacatggtgccaggcacttgtagtcccagctactcgggaggctgaggcaggacaatggcgtgaacccaggaggcggagcttgcagtgagccgagatcgcgccactgcactccagcctgggcaacagagtgagacttcgttttttttttaaaaaaaggctgggcacagtggctcacacctgtaatctgccagcactttgggaggccgaggcaggtagatcacctgaggtcaggagttcgagaccagcctcgccaaaatggtgagaccctgtgtctactaaaaatacaaaaaattagccgggtgtgttggcgtgtacctgttatcccagctactcgggaggtgaggcaggagaatcgcttgaacccagaaggtggaggttgcagtgagccgagatcatgccactgcactccagactgggctacagagcgagactccataagaaaaaaagaaaaaaaaggggggcaaaaagaaacagatgaaaccaatgtgaataatttattttaacacaatatacctaacatatttttatttcaatatctaaccagtataaaaatttacttgttttgccctctagagatagtaagctccttaagtaaacagaagtaatacctgattaattagaattcccaaccctcatcaagtgtgtgcttatatagaagaaacccagtaaatgtttgttgattgaaagatattaatactcttgcttggatgagagtgaggaaaaaggtattagtattggcttttcacaacgccttgtacggtttcttgtttaagttgatcaaagcaaaagaaagactgcaggcaatgctaaatataacaagtgatttacaaattaattagacgtaaataatcatttttcattaaaaattagttgtattctgtccatttcctcagaattttagacaatgattttgaataatcatatctcccttatagagttattgaaattaaataacttattgggaaagattctttataattatacaaaggtatataggaccatagtctcatatccagagttctgaaatccgaaaactaaaaggtttttctttttttgctattcttttttttttttttttttttttttttgagacagagtctccctctgtcgcccaggctggagtgcagtggcacaatctcagctcactgcaacgtccgcctcccaggttcaagtgattcttctgcctcagcctcccgagtagctgggactacaggcgtgtgccaccacactgggctaatttttgtatttttagtagaggtggggtgtcaccatattggccaggctggtctcgaactcctgacctcgtgatccacccgcctcagcctcccaaagtgctgggattacaggtgcgagccactgcacctggccaaggttttttataactaatttaacagcaaaatctggcctagttatcgtctttattttctttttttaatgtgatttaaaactattcatttgtttcactatagcttaataatttgtttgcttttctgcttctaagaccctgtaggggcattatataacttctggcatttgcatagtacctttacaaaatccaaaaaaatctgaattctaaacacatttagtcctaaaagttacagataagggattctggacttgcgattctaagtctttgttcgtttttattgcattttctgagccaacataaccattatttaaaaacaagttgctatagtaactctacattacagacctcccccaaactcagcagttcagagcatgtattctcactcagggctctgcttccttgtaggtagatgtgtggatcggtgagggcagttcttatttgtatgccttattctggggcccaggctgaaggggcagtggctatccatgataagcttttctcaaggcaccagcagaagtacaagaagtcaaggccaactgcataagcatagttcaaatgtctggttatgccacatctgctaagattgcattgaccaaagcaagtcacatgatcatgcccaaagacttaggagtgggtagtagactgcaaccaccatgcagccaagcaaactacagagccaagcctataacatcactggagagaggtgtattcctcccttggccaggctgggggagggagtgaatattggctgaataataatctaatctaccacagatggttaacagaggtggagtgggatggaaggagaaaaaaaaaaaatcaccaaatgggatgtatcactacccttgctctttttagcgtctgctgctttcacaaagccttttatagggctggagaaatgatttgctcctagtctcttaaaaaccagaggagtcttttgaggatgtattcctaaagtttttaaattagtttaaaaattttttttattaatttcaattataggctgagcacagtggctcacgcctgtaatcccagctaaggtggtggatcacctgaggtcaggagttcgagaccagcctggccaacatgctaaatgaaacccccatctctactaaaaatacaaaaattagctgggcatggtggtgggcgtctgtaatcctagctactcaggaggctgaggcaggagaattgcttgaacccaggaggtggaagttgcagtgagccatgatcgtggcattgcattccagcctgggcgacaagagtgaaactacatcttggccgggtgccgtggctcacgcctgtaatcccagcactttgggaggcagaggctggcagatcacgaggtcaggagatcgagaccatcctggctaacacagtgaaaccccgtctctactaaaaatacaaaaaattagccaggcgtggtggcgggcacctgtagtcccagctacttgggaggctgaggcaggagaatggcctgaacctgggaggcggagcttgcagtgagctgagattgtgccactgcactccagcctgggcgacagagggagactccgtctcaaaaaaaaaaaaaagaaaagaaactacatctcaataataataataatttcaattataggttggaatttagagttcggttacatttactattggatgtgatcctttaaaaactcaagtagaggcttttccagcccattcataacattagaagttgggccgcctgtccagggagaagctttcaaagtaacactgaggctgattaaatacttttgtaaaataaagaataaatcacaagctcattggcacttgaaacttagcattgcagtgcagatgcagcagaaaatacttgtagcagttttctcagtgaaagagaaactagtcaagtagcttagagacattaaaacaagccacaagccctttgtgctagagatcatggttaaaagtcccctgaagatgtttttccacagtagaaattttgtttatatttatgtctgagagtgaaaaaagaaaatggaatcaataagtaaccatgttctgcaggagtttgaggttttgttgttacattgggatgtagtgagagaagaaaacgtattaattcttttctgttggtactttcttgaattacatttttaataaacttattgtgagattctgaacattgctcctgtgataatttctgaagtgctgatgagtagaaggttttctggttagacttctgttcagcacatctgagcttcgagattatttgtagttctcctggggcttttaaaatctctttgtatataatagataaatgctagtttcccatcagagaaggatttctttttccttttgtctgattgagcaagtgtcttgagattaagaaaatggatgtcagtgaattcaagtgttgtgctctgtcagtttgcagcaggtgaccagagagcaaaaacaccaaagtagattctgtccctactcccacctactcctcaattcgggtcccatgaaagatcctcagatctgggtaactgttgttgtttttgttgttcacagggctaagaatgttcatggctaagaatgttaaaaagtctcctagtgtcttttgccacgctgcctgaacagtggggtcattgaccgccatgcaatcctcaattgttttcagctgatactggaccgaaatcaaatctagctttgcctgcccctttctttgtaccagtagcgcttgtttgttcaccaggcctgactgaagacctagccctgttgcctgcctctgcttcctaccgagccccctgtaaagagcagctctcccagggaggctcaccttgtagcattgtgatctttggaagcatcaagggaggcacaagatttctctgggtgaactggaaaagacttgggctgggcatcagaagacttgggttctgcaactggcattgtttacactctctctgtaactctgtgcaggcaaaatctttcaccttttctgagtttttttttacatgtcagtacagattcctttcctcatgaggtttctttaagactcaaatggaagaatagatgtgaaaagaactttgaagatagtattggaaaatgctaaagtgactgctgtgttattgatgatttttatgggatttgtctgagaaagctccagtgtgaccagtttgtaccagcttgtatggtttcttgtaataaccgaacagatcctgttagcatagggtaaaaatggaaactacttcttttaaaatgaccagtggctgcagtggctcaggcctgtaatcctggctagttgggagactgaagtggtagggttgcttgaggccaggcaagaccagcctgggcgatacagcaagaccctttctctaaataaaaaactagccacccatgtagtcccacctgcttgggaggctgaggtgggaggatcgactgaggccaggagttcaaggctgcagtgagctatgattgccactgtactccagcctgggtgacagagtgagaccttgtctcttaaaaaaaaaaaaaaaaaaaaaaaaaaagatttgcattatagcttatctttttttttttttttttttttttgagatggagtctcactctgtcacccaggcaggaatgcagtggcgtaatctcagctgactgcaacctctgcctcctgggttcaagcaattgtcctgcctcagcctcccgagtagctgggactacaggtgcacgtcaccatgcctggctaatttttgtattttttggtagagatcgggtttcaccatgttggccaggctggtctggaactcctgaccttgtgatctgcccaccttggcctcccaaagtgctgggattacaggcgtgagccactgcgcccagccagcttatccttttttaaaaaaacataaatactaggatattgagattattgaaaatgcttttggtgcttcagttttgaatttatacttagagcagtttttgaagtttaagatctcatttacttctaagtaatagatttactagtaatcaaaatcgcttcaaaataccgtaatcctcattgctgtaaactcctacggggcaggtttggagttttataaagaggcaatatagtgtactctgtgaattccaactcctcacttgccagatgtgaccttaagcaagtgaacttctgtgtgccacactgttttcatctgtaaaaggataaagggaatatcataaattagtttgttaagccttagtttaataatgtctctaagttttacatataagtagacagtgtctttcttgtttagtgaataatcattcttattatttaatagtatctctactaaatttattgtgtaagattatactaatcttgtttagtgcgtggtaatcacttctgctcatatttaacctataagcataatatagtttatttatataccatttatttattttattttattttttgagatgcagtcttgctctgtcacccaggctgcggtgcagtggcgcaatcttgcttcactgcaacctccacctcccaggttcaagcgattctcctgcctcagcctccttagtagctgggattacaggcacgagctaccatgcccagctaatttttgtatatttagtatggacagggcttcaccatgttggccaggctggtctcgaactcctggcctcaaatgatctgtgtgcctcagcctcccatagtgctgggattacaggcatgagccactgcgtccggcctacttaccttttatttttgcttgcattaccctttctttgccttgtttcatttggctaagactgtcttgtttacttgctttgcttctgagggattatatgagagttctatgggtttttccataatggagtgtacttttattattttattatttgtttttttgagacagggtctcactctgtcactcaggctggagtgtagtgatgcagtcactgctcactgcagctttgactttcttggctccagtgatccttccacctcagcctcctgagtagctggaaccacaggcacccaccacccacacccagccaattttttttgtatttttagtagaaacagggtttcaccatgttggccaggctagtcacgaactcctggcctcaagtagtaacacccatctcagcctcccacagtgctgggattacaggcatgagccaccgagcccggcctcatgcaatttattgactacttcactgaaagtgaacttgtatggatactcaaaaagtacagtttgtattgaatacatattgtttttgcatcatactaaagctgaacagttctaaactgaactgtcatcagggaccgtctgtattgtgaaatcttaattttgtccatattaaaagacaggaacagggctggttcgtggtggctcacacctgtaatcctagcactttgggaggctgaggtgggtggatcacttgtggtcaggagtttgagaccagcctggccaacatggtgaaacccagtctctactaaaaatacaaaaattagctggacatggtggtgcacacctgtaatcccagttattcggggggctgagacacgaaaattacttaaacccaggagttagaggttccagtgagcgagatcgtgccactacattgcagcctgggtgacagagcaagactgtgtctcaaaataaagacaggaacaaaggtatcgataactcttaagtataggttaaattcccacaaaaatctagttttaaaaaatctttttttttttttttttttttaaaaacagagtctcactctgttgcccaggctgagtacagtgacgagatcttggctcactgcagcctctaattcctggactcaagccatccccccacctcagcctcctgagcatttgggactacagatgcatcccacctgcacccagctaattatttttttgtagagatagtgttttcctatgttgcccaggctggagactgatctgcaactcctggccttaagctctttattttttaagcaaatttgcactgttttcaattaatatgaatttgcatttcgctgatctcatgctagctgacaatgggctgaaggtgaggggaggagaaagatggacatggtacataaaagcatgtatgataaagtggaatgtcaccttggttaaaaatgtgtaatgatttgaatgatacaaatataagtagttaagggttattttgaacttgatacctttgctggaggaaaaattactttatgcatttttgatgaaaaatcattagaagaaaaaaaatggaatatttagaggaaagagtatcctgatgttaaaagtgaaaatgaaataggacattgagaaaatttttttatgtaaatgtgtatatggtaatgtattaattagcgttaggtatgtacacggatttttgccttctatatttctgaaaaccttctgtgaaaaggaagagttgaaatcataaagaattggctgatggaaattaaggtagacaggcaaatgggaatgtggcccccctaggagggtgaactctgagagacacagtcatccctgtaaataaggctgcgccaagatcaaaggagaggtctgaggctgggagtcaggagtcagccattcttttttttttttttttctgcaacctccacctcctgggttcaagcttttctcctgcctcagcctcctgagtagctgggattacagatgcgcgccaccacacccggctaatttttgtatttttagtagagatggggtttcgccatgttggtcaggctggtttcgaactcctgacctcgtgatccgcccgccttggcctcccaaagtgctgggattacaggcatgagccaccgctcctggctgagtctgcgatttcttgccagctctacccagttgtgtcatcttaagcaagtcactgaacttctctggattcccttctccttttgtaaaataagcatgttatctgtccgtcctgccttgggcattgtgataaggataagatgacattatagaattttgcaaaattaaaagcgctagacaaatgattttatgaaaatataaagattaggttgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaaggtttgtttctgcttaatgtaatctatgaaagtgttttttataacagtataattgtagtgcacaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcgcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccagctacatacacagacatgaaatttgactgcaactctactagctaatcatcataaagtgagagcagaggccaggcacggtggctcatgcctgtaatcccagcactttgggaggctgaggcgggcagatcacctgaggttaggagttcaataccagcttggccaacatggagaaaccccatctctactaacaatacaaaaattagccgggcttggtggcaggtgcctgtaatcccagctactcaggaggctgagccaggagaatcgctggaacccaggaggtggaggttacagtgagctgacgtcgcgccattgcactcgagcctgggcgacgagcgaaactccatctcaaaaataaataaataaacaataaataaatagagaaaaagaaagaaaagaaaagagagagagcatggatgtcctgtgagacagttggagtatctataggatttttagaggtggacccagaatagaggaaaacacaaggccaactataagctatccagttgcactaggtgtggggtcagattttcctctgttaggaccagagagcagagctaggaacagtggtggaagttaccaggcaataaggtctggatcaataaaaagaactttctcatagcctggcatggtggtgcatgcttgtagtcccagctactcaggaactcaggaggctgaggtacgaggattgcttgtctaagagtttgagtccagcatgggcaacatagagaggttctgtgtttttttttttttaattttcccacagttatggtacatctgggctgccttgtaggcttgtgtgtacatttcactacaaacagtcacaaaaggctggaaggccactccagcaagatctgtagaggattagtccgtgaattccgcagttgaactagagcactgaatggcgtggaacttccttttacactctgaagatttaggattcttcacttttcccatcagtaaaattaggtaatttactagataatttgaaaattctttcccagctgggaagttttgatgtgcccagaagctaggatgggcagttgtccaggtttgtttaaaactagaggttctagaacacaggactttcagttttaaaattgggacagtcctgagcagtaggatcaagtcagttgtctaccagagtataatcaaattgaaataattttggatctgactaaccaagtcttattcaattagttgacattgttgtttaacttcgagtactattacagttctatattgttatagttcaaatagaagataacatctaaagcatttctcattccaaaggttaaatcttgcctttagcttcatttcttcaactctaagcaaatactgtgacgagctgctatagcctggaaaatagttttccttttgtgggctgctgtgcataatctcattcatagtaaagggatttgaagtttgatgacagaatagtcagagagctgaagttgtgtttgtttttttagcccaaatatttatttctcaagtttttgttgtgaaatgtttctagcacatacagaaagtatggcacataatgtaataggcacccatgtacctatcacccagctttattaaaccttaacatcttatttgctgtttttttgataagctttttttgcttctattgcttattgatcctacactaaatgaaatcctaactaaacaaaacaagattttgcatttaatttgaaaagagactagttatatgacaaaaaattgcagataaaattgaagtgctcctcccccattctttttcctcttttctcaggatagttactgtcctgaattgggtatttaccatgtttaataaaattgagtattaggcttactataatatttatgtacataaatcgtatcgcattatgtaatacacttggcatgttttaaaactttaggctgggtgtggtggctcacgcctgtaatcccagcaatttgggaggccgaggctggtggatcacaaggtcaggagttcaagaccagcctggccaacatggtgaaaccctgtctctactaaaaaaaaatgcaaaatttagccaggcgtgatggcaggcacctgtaatcccagctactccagaaactgaggcagagaattgcttgaactctggaggtggaggttgcagtgagccaagattgcaccactgcactccagcttgggcaacagagtaagactctgtctcaaaaaaaaaaaaaaaaaaaaaaagccaggtgcggtggctcacgcctgtaatcccaacactttgggaggccgaggagggcggatcacgaggtcaagagacagaccatcctggtcaacatggtgaaaccccgtctctactaaaaaaatacaaaaattagctgggcgtggtgacacgcgcctgtagtcccagctacttgggaggctgaggcaggagaatggcatgaacctgggaggcggagcttgcagtgagccgagattgcaccactgcactccagcctgggcgacagagtgagactccatctaaaaaaaaaaacaaaaaaaaactttatgtggtttatgtctgaaagttgaagagaatttccacatatatgttagtatatgttgcaaaagagacattcctatgtagaattttgggcattcatgtatatgtagatgcatgtagctctagcatttgttttctcttgtgaatatataaaaataattctgtttacaaacatttggtaggttccagtttttcacaataactgacagtgctgcagtgacatactaattcattagtctgtgtgcacttgtgtgagtttctcaaagatagttgctgtgattggatatatggatcttagaactattttagagattgctaggattcttccaaagtgtatattgcaggccaggcatggtggttcacggctgtattacatctatctcagaaaaataagagaagaaaagcatgggtgatcttggtgatttccccctttcattttctaaatgttctataatacagttatttaataatttaaaaagctattttgaaaaagtaatctcacgctgtcaccaaagctggagtgcagtggtgcaatctaaactcactgcaacctcgacctccttgagaccagggtggtctcaagtgatcctgccacctcagcctcccaagtagctgggaccacaggctcatgccaccacacctggctaatttcttgtatttttggcagaaatgaggtttcaccgtgttgcacagtctggtcctgaactcctgagctcaagtgatccacatgtcttggcctcccaaagtgctgggattacaggtgtgagctactgcgcccaacctaaaatattttatatatatatatatattttttttttttttttttttttttttttttttttgagacggagtctcgctctgttgcccaggctggagtgcagtggcacgatctcggctcactgcaagttctgcatcccgggttcacgccattctcctgcctcagcctcccaagtagctgggactacaggcgcccgccaccatgcctggctaattttttgtatttttcatagaggcggggtttcaccgtgttagccaggatggtctcggatctcctgacctcgtgattcgcccgtctcggcctcccaaagtttttttatattttttaatgtgaggaaaggtcacaaaagaatagtatgctacctgaggaatatctctggaaagggatcaagcattcgaggttttctgtgatgactgactaaagtcatggagttagaacagctgatacaaaagaaaccaaaaaaggccaggcatggtggctcacacatgtaatcccagcactttgggaggccgaggcaggtggtcaggagtttgagaccagcctggccaacatggtgaaaccccatttctactaagaaaaaaaaaaaaaaaaagtcaatgggtgtggtggcatgtacctgtagtcccagctactcaggagactgaagcacgagaattgcttgaacccaggactcagaggttgcagtgagctgagattgtgccactgcaccccagtgcagtgtgacagagtgaggctgtctcaaaaaaagaaaaaaaaaacccacaaaagctcggtagcatgagatctttgagagcattcttatgttcttattggtaattggagtttatattatgcccttgtcatcaataatagcttcagttatgtttcttagtctccatttgaaaaaagaaatattcgctgggcatggtggctcacgcctgtaatcccagcactttgggaggccaaggtgggtggattacttgaggccaggagttccagaccagcctggccatcacggtgaaaccctgtctctattaaaaatacaaaaattagccaggtgtggtggtgcgcccttgtaatcccagctacctgggaggctgaagcaagaggattggtttcaaggttcacctgggaggtcaaagctgcattcagccaagatcacaccattgtactccagcctaggtgacaaagtgataccctgtctcaaataaatacatagacaaaaagcaaacctatgagctatttaaaggaccttgaggagaaaaaaaataaatgaaatgggtgatctaaatttaaatagaatctgcagctctggttagcctttgacagtgttgttgtatcattatagttatgaatttgttttctcagttgtgttaaagtggagtaaggcaaaaaagaacttgaaatctcaacgacctccagagaaacatgctagcttttgcatgagtaaaatctcttaggcacaaatattaataatatgttaagaaactttaggcttaagcctaacataacagccccataagtgttcagtattatctctaaccagttatgtcaactgtttgtggaaatgacagcctttcttggcattagaggaatggttaaacctctgactccagggaatcacaaagcttggtcagatgctgaatggaattatgtgtgttgttggaagcatgttccctatgattaataaatgttttcaagttttccacttaacttgccagttctttggttaagccactcttctagtcctgtcctacagagcaggcttagagccccacatttgtcattgtagaaattcaaacaatatccattaagtcatttttttttttttttgcccattaagtcttaaaggattaatacattttctttccttttttttttttttttgaaacggagcctccctctgtcgcccaggctggagttcagttgtgcgatctcggctcactgcagcctctgcctcccaggttcaagcgattctcctgccttagtctcccgagtagttgggattaacagggttgtgccaccacacctggctaattttagtattttagatagagatggggtttcaccatgttggtcaggctggtctcgaactcctgacctcaagtgatctgaccacctaggcctctcaaagtgttgggattacaggcatgaaccaccgtgcctgccaatacattttcttacaaatattaattattgaaaaaatgtattttaagtaaatattcagactataaatatatcagcataattgaatacattataaccacgtaggcatgttaactgcttacatgcgtgcatgaaatattaagggaaaagggcagaatataatatttgtaaacacaactatgtatacctgtgtgtatatattgaaaaacgttagcatttggggtgtcgtaaaaataagtttctgttttctttataaaattacctaaattcatattcaactacacacaattataaacttaattgcagagctaggtgtggtggctcatgtctgtattcctagtactttgggaggctgaggcaggaggatcccttgaggccaggagtttgagactagcttgggtaacatagcacgatcttgtctctacaaaaaaaaaaagtgaaaattagtggggtgtggtagtgtgcttctatggtcccagctacttgggaagctgaggcaggaggattgcttgagactaggaggtcgaggctgcagtgagctgtaatcatgccactgcacttcaacctgggcagcaaagtgagaccctgcctcaaaaaaagaaaaaaatgtgtggcaaaaactgccatgaacaaagtccaaaacaaactaggacaaaggcttgaaatatatgacagatatatcccaatatacatagaattcttatgaaattaaaaggaacatgaacaacttaactcagtagcaaaggttacaagcaatatttatggagtaagaaatagaaatggcaataaatatatgaaaagcctagttgatcagccttactaatagggataaaaattaaaacttcacttcttacctatcagtgagttaaaattgatacactgctgctgaggttgtagggaaataggctttcttgtatgctgtgttctttggagttaagttagtatttatttggaggcaagctcttaattgaatctacagatacacatgccttttggaaataatttagcaattaaatctaacctaatctgatctcacctagcatttcacttctgaaagtttatcctataaaaatattaccatagaagtgccaagaatttttattgaagttttatttataacagtgagaatgtggcagtaatctcaatctttatcattaattgcttatggtttacccagttagtagtgtaaaggtactagttaacagtagggtctcttgactaaacagttggactttgaatctccattctagaacttcttagcattatgatctttggcaaattaactggcctcgctaaacttcagtttctttatctgttaaatgaagtttatagcaattaacttagagttttatttaaattaaatgagataaactgaatgattagtacactacctagcacatacttgttcaataaatattaacatttcttatcaaaattgccatatttaagaatgaggtatatttatatgtctagcatagaatcaaatatatattatcattattattttttttttgagacagggtctccttctatcacccaggctggagtatagtggtgtgatcatagctcagtgcagcctgtaagtcctgggctcaagtgattctcccatctcagccttgtgaatagctgggagtacaggtgtgtgccaccatgcctggctaattttttttgctgttagtttcactttttttgtagagctggggtctcgttatgttgcccaggccggtcttgaactcctgggctcaagcgattctcccgtctcggcctcctgaagcatacagattttttagggcagtgaatctattctgtatgatactgtaatcatggaaacctgtcattatctgtttatacaaacccatagactgtataacaccaaaaagtgaaccctaaggtaaactgtggactgtcaatgtaggttcatctgttgtaacggtttaccacagtggtgcaggatgttgatagaggctgttggaggggttatgtgggaactccgtgtactttctgctcagttttgctgtggatctaagtttgcatttaaaaatattttatggcttggtggctcatacttgtaatcctagcactttggaaggctgaggcgggtggatcacttgagttcaggagtttgagaccagcctgggcaacatggtgaaaccccatctctatgaaataaaaaaaaaagtaaataatactaatagtaattaactgggtgtggtggcatgtgcctatagtcccaggtacttgggaggctgaggtcggaggatgacttgagcctgtgaagtggaagttgcagtgagcagtgatcatgccactgcactccagcctgggcaacacagccagactcggtctcaaaaaataataataataaaataaataatataaataaaaataatattttgaaagaaaagagctatcaagccacaaatgcaaaaggcttcaagttcctatcttttagaaatacatactaaaatatttatgaaggaaatgatatatctaagatttgcctcaaaataatactggagtggcaaagtgagcgggggagtagatgaaacaagattagcatgagttcataattattgaagttgaataaattgcacatgggcttcattgtacatttctgacagtatttgtttgaactttttccataataaaaagttttgtttgtttttttttttgagatggagtcttgctctgtcacccaggctggagtgcagtggcatgatctcggctcactgcaagctccgcctcccaggttcacgccattctcctgcctcagcctccagagtagctgcgactacaggcgtccgccaccatgcccagctaattttttgtaattttagtagagatggggtttcactgtgttagccaggatgatctcgatctcctgaccttgtgatccgcccgcctgggactcccaaagtgctgggattacaggcatgagccaccacgcctggccttttttttaaaatggtcttacaggtaataccatgcatgcttaagtcatcattctcatatttagctaccaagatttttcctttcggaaatccctcagtattctagtaccactttcctctcatttgacacttttcaaagcacctacacactcccttgagaaagatacctttttttttttttgcgagggagtttcactcttttgttgcccaggctggagtgcagtggcatgatcttggctcactgcaacgtctgcctcctgggttcaagcgattctcctgcctcagcctcctgagtagctgggattacaggcacgcaccaccacacccagctaatttttttgtatacttttttttttttaagtacagatggggtttcaccgtgttggccaggctgggctcaaacttctgacttcagatgatccgcctgcctcgatctcccaaagtgctgggattacaggcgtgagtcaccacgcccagcccaagaaagatacatttttaaaaacagctttattgtggtataattgacgtaaaatgtacatacttaaagtatacagtgtgatgttttgatatatatgtatactcttgaaaccaccaccacagttaaaataatgaaaatgtccattacctccagaagtttcttcatgttttgttgtaatctctccttctcctccctgattcctccccatccccaggcaaccatgttttgtcaccgcgcgcagccatttactattatgatactattttatataaatagtatcatacaggccgggcacggtggctcatgcctgtaatcccagcactttgggaggtcgaggtgggcgatgacttgaggccacctggccaacatgaaaccccttctctattaaaaatgcaaaaattagccaggggtggtggcgtgcacctgtaatctcagctcctcaggaggctgagacatgaggattgcttgaacccaggaggcagaggttgcagtgagctgagattgtgccactgcactccagcctgggcaacagagtgagtctctgtctaaaaaaaaaacaaaacatacagactcttgtctggcttctttctttcagcataattattttgaaattcgtccatgttatgtggttcctttttattgctgagttgtataccacagtttttgatctatttacttgttggtagatatttggattttcagttctgaagcattacagatagtggctgttacggatattcatgtacagatctttctttgtatgggcatatgctttaatttatcttgggcaaatacctaggagtagaatatgatccaatatggtaggtgtatatttaacttttttttctatctatctatctatctatctatctatctatctatctatctatctatctatttttaagacggagttttgctccatctggagcaaaggctggagtgcagtggcatgatcttggctcactgcaacctctgcctcctgggttcaagtgattctcctgtcccagcctccccagtagctgggattacaggcgcctgccaccacacccagctaatttttgtatttgtagtagaggctaggtttcttcatgttggccaggctggtcttgaactactgatctcaagtgatctgcctcggccccccaaagtgttgggattacaggcgtgagccatcacacctggccagtttttatttatattttttatagaagatggagtcttcctatgtttcacaggctgatcttgaactccaggcctcaagtgatcctcccgccttggcttcccaaagtgctgggattataggcatgagcctctatgcccagccttatatttaactttttaaggtactaccaaagaactttccaaactggttgtataattttacatttctaccagcagtatgagttccagttcctccacatcctgtcagtacttgatactgtcagtcttttaaattttttagctcttataaaaaggtatatagttacatctcattttggttttaatttacatttctctattgagtaatgatgttgagtttcttttcatgtgcttgtcatcctgatatctttggtgacttgtctgttcaaatctcttgcccatttaaaaattgctttcttaatggattttaagaattatttacatagtctggatacaagtcctctgtaatatatataatttgcaagtgttttctcccagactgtggcttttctttttattaacagtgctttttgaagggcagatttttttttttttttttaaagagacagagtcttgccctgtcacccaggctggagtatagtggtgtgattatagctcactgcagcctcaaactcctgagctcaaagaattcttctgcctcattcttccaaacagctaggactacagatgtgtgccactgcacccagctaattccgtttgtatttcattgattgtgtttttggtgtcacatcttaagaaactttggcctacttcaagttctcaggagttttttcctgcattttcttctggaagctttatagtttcatgttttacattaggtctgtgatccttttgaagttgattgttatacgtggtccaaggtatggatcaaagttcatttttctgcatatggatattcaattgtttcagcactgttttttaaaaaagactattttctccactgaagtgcctttgtacctttgcaaaaatcagttgtccatatatgtgtcaatctgttccatcagtcatgggtcaaaggctgttctcatggggaggcttttgaatttgaaaaactgaaactctatactcattggacaactttatacccattgaacaactccccattttccatttctctcagcccgtggcaatatgctttctgtttctataacatggactacttgagtttttttcttttttttgatgacaagatctcactccgttgcccaggctagagtgcagtggcatgatcttggctcatggcagccttcacctcctgggctcaagctgtcttcccacctcagcctcctgagtaactggaactacaggtgcactctatcatgcctcgctaattttttaatttttttgtagagacgagttctcgccatattggccaggctgatctcaaactcctgggctcaagtaatcctcccactttggcctcccaaaatacagagattatgggtgtgagccatcatgcccagctggctagatatttcatgtaagtggaatcatacattatttctcttttagtgacttgcttattttgcttagcataatgtcctcaaggttcatctatattgtagcatgtgacaagatttcctttttaagggctgaataatattctgtgttatgtatataccacatatctgtgagtagacatttgggttacttccacttcgtggctatactgaataatgctatggtgaaagtggctatgcacatatctgtttgaggtcttgtttgtaattcagttcgtttttatatatactcattggtatttatataaatgggattgctgggtcatatggtagtttaattttttgaggaacctccatattgttttccatggtggctgcaccattttacattcccaccaacaatgcatagtggttccaatttcttcacaactttaccaccgcttgttactttctgttttttggtagtggccatcctaacgggtgtagtttttttttgcatttttctaatgattagtgatgttgagcatcttttcttttttccccccatattacacagatgtagagcatcttttcatgtgcttgttggctatttgtatatcttctttgaagaaatatctgttcaagtcctttgcccatctaaaaaaatctgatgatttgtttttttccaattgtttaattgtaggactttttttttttttttttttttttgagatggagtctcgctctgtcgcccatcctggaatgcagtggcgcgatcttggctcactgcaagctccacctgccgggttcatgctattgtaggactttttaatgtattctggatattaatctcttaccagatatatgatttgctttttttttttttttttttcgatacaaggttttactgtgtcacccaggctggagtaaagtagtgatgtaatctgggctcactgcaacttccgcctcccaggctcaagcagtccttccacctcagcctcctgagtagctggaactataggcactcgccaccatacccacctaatttttgtattttttgtagagacggagtttcaccatgttgcccaggctggccttgaactcccaggctcaagcaatccacctgccttagcctcccaaactgctggggttgtagatgtgagctaccacacccagcctgatttgcagatattttctccagttctgtaggttgccttttcactctgatgactgcttcctgtggtgtgtagaaatttggtgtaggcccatttgtctatttttgtttttgttctttaatttctcttagcaatattttgtaagtttcattgtacaggatatttggggatctgtaagacaaccctcaggttcagtaatttgctagaaagactcaactcagagaatgttttatactcaaattatagtttagtacattgaaatgatatggattaaatttagcaacagaaaaagacacatagggcagggtccaggagacaccccaggctcaagctgtcaatagtcctctcccagtggagttgtgcacacagtgcttaatttttccagcaacagtgtatgacaacacacgtggaatattggcaaccagggaagctggctgagccttggtgtccgggtcacacatggctgacctcagttctctggccccttcagaggccaagctgatactgtgtgacacaaggccctcaccgtagatcacattattagcggaaacttgttggcatgacccaatgcctcatgtaaacagcgcagtggctgtttataggccgggcgcagtggctcacgcctgtaatcccagcactttgggaggctgaggcgggcggatcacctgaggtcaggagtttgagaccagcctggctaacatggcgaaaccccgtttccactaaaaaaaaaaaaaaaaaaaaaaaatagaaaaagaaaccaaaccaggtgtggtgataagtgcctgtaatcccagctactcgggagactgaggcaggagaatcactctaacctgggaggccaaggttgcagtgagccaagattgcgccactgcactccagcctgggcaacaggagcaaaactccatctcaaaaaaaaaaaaaagttaaatagaaaaaggacataaatgaaaaagcactcaaccatcctgataataagagaaatagatattaaatttatgccaagattccatatttctcccatcagattggtaaaaatctaagcacttgctaacataaggtgttagcaacagtgtggtaaagtaggcaatctcttgcattgctgattctctaaattggtgcaatccacagggagggcaatttggcatgctctcgttctctctctcgctcgctcgcgcgctctctctctctctctccatgagaaggagagagagagagagagagagcacgcgaacaagcgattgagtgagagagagagcacgtatctgcagtctcagctgctcaggaggctgaggtgggaggattgcttgagcctaggaggtcaacgctgtggtaagctgttgactatgccactgcactgcagcctagtgacagagaatctgtctcaaagataagaagaatgaggatattctttatgtactgatgtgtagaaaaatctctaagatacatagttaagtggagaaaacaaaatgctgcatggtgcatttactgtactaccatttgtgtgaaaagggggagtaagagtatgtgtttgtatttgcttgcatatgtagaaagaaactttgaaaggattcaccaaataacagtagtaagcagggggattaggaaactaggtatatattaagagggagcttttgtactctataccttttaatactttctttgagaccatgtgaatgttttacctatgtatttatttatttttaatttttgctttgcctgcttttaaacaaataaattgtactttttttgaagagctctatttttatttcctttcgattatcatctgtagattcttatgtcacattttactttaacagcacatttagacagaatacagtctttaaatggaagccgacaattgatttccctggaaaatttttgaagtacaataacatttgattgattgaactttatttagtaagaattcttagcaaaattccctcccaggcacacctacatggtgcttcattttcagtgaactacaaatctctgaaacccaaaactgcaatctaaaagtacaagatggctggactcgatggctcatgcctgtaatcccagcacttcgggaggccaaggcaggaggattgcttgagcccagaagttcaagaccagcttgggcaacatggtgaaactttgtctctacaaaaaattagccgagcttcacaaacaatcttacaggagtcattcattaattaactcaacaaatatttatagagtacaggagacactagagatccagcaaaggtcaataacatgtgctgtcttagagaaaacttatattctaagaatagtcaagtgacaaacaggagctacatcaaataatcacaagtacacttcagagaattaaaaccagatcaacgtagagaaaggcttccttacattcgatagtcaggaaattctctctctaccaggagggaactgagtgacaaggaacagtcaggtgggagaagggcattccagatgaaccagccctgagcggggaactagaaggccagtttgagaaaaggaatggagagaggaggaacagtttgtggtcagagcaaggaccaaaccattttagacttcatgagcctaagaagttttgattttgttatgagcatgacaagaagccattgtaatcgagttttaaacaaaggaatgacatgatctcattttgtttaaaaaaaaaaaatcatcctggctgtagtgtggagaatggactaggggagcataaaagcagaaagaccaattggaagcctattaacagtaatccaaatgatagataatagtggtttgaaccacaaagattatggacatagaaagaagcagatagatccaggagatgttttggaggtattctggcagaatttgctggctgactagacagaggtactaaggaaaagaatcaagaataattcctagattcgggacttcctagaaactgggagaatggtgctgctgtttattgagataaatggagaagacagaggagaagcttagaatagagttctaggagaggtcagagatggagatcaacatttgggagacagaattttctaattccatagtgccgacgattttctattgatagactaaaaatgtctggaattttatatgcagtttcatctggacaataccctaagaggagatcagttataccttggcacctgctaatagccataggaatatgtatatgtagaataaatggtaaaactactgaatgcttaatatgtgccagacaccgtgagatacgtctttgaagtactatcccagtagaatttacaacaaccctatcaggagatactttttttatcaccattttacagatgaagacactgaagttcaaagaggttaaataactcgccccaaatcacactatatagaagagaaatctaaatcctggtagtctgaccccagaacttgggctaattaccactatataatacagtgtcactggggtaaacccaagatatgataacataagttagagacttttaaattccaaatttcacacactatgatttcacccataaaatgtagtgattcagccatagtcttctgattagttggagtaccctatgcaatactttaggaacttgcttcttttattttcatatatatatatgttcattcataaattaaatctggacagccagtgaatctgccatttttgtctctaaccaacacttctgtcacaaaattgtacttttttttgtttttttttgagacggagtctcattctgtcacccaggttggagtacagtggcacgatcttggctcactgcaacctctgcttcccgggttcaaacgattcgcctgcctcagcctcccaagtagctgagattacaggtgcccgccaccacactggctaatttttgtatttttaatagagacagggtttcaccatgttggccaggctggtcttgaactcctgacctcgggtgatccgcccgcctcagcctcccagagtgctgggattacaggcatgagccaccacgcccggcccaaactgtgctttttttaaataaagaaattaaaacagtatttttttccttaaagatggtgtctcactacattccctggctcaaacgattctggctcaaacgaattcctaggctcaaacgattctcctgcgttagcctcctgagtacctgggactataggtatgtgccactattcctgaaaacataatcagttttgaaggtagtgtctgggctgggcgcagtggctcacgccttcaatcccagcactttgggaggccgaggtgggcggatcacctgaggtcaggagttcgagaccagcctgaccaacatggataagactccatctctactaaaaatacaaaaaattagccaggcatggtggcgcatgcctgtaatcccagctactcaggaggctgaggcaggagaattgcttgaacctaggaagcagaggctgtggtgagccgagatcgcaccattgcactccagcctgggcaacaagagtgaaactccgtcttaaaaaaaaaaaaaaaaaggtagtgtgtggccgggcgcggtggctcacgcctgtaatcccagcattttgtgaggccaaggtgggcggatcatgaggtcaggagttcgagaccagcctggccaacatggtgaaaccctgtctctactaaaaatacaaacattaagccggcgcagtggtggatgccgataatcccagctcctcgggaggctgacgcgggagaattgcttgaacctgagaggcagaggttgcagtgagccaagattgtgccactactaggcgacagaatgagactctgtctccaaaataataataataataataataaaataaaaataaaagtagtatccagcgtactacaaagaggaagagtttgtgaatgtgtatgttactgttaagttaaacagtgttctagtatccatctcattatcagccttgggcagggcagggttgagttggctaatgttcattataaaccagatcatccagttggggactctgaatgagcatatgattgcccctttcatgctagacttagctaattaaactgttcatatgacctaaaaggatggctgtggtgccatagaaagaaaacaagttttgaggcaagagactttagtttgattcctacctctgctgttttctggttgtgagatttttggatcagttgcttttgtgttcatttaccaaaacttctcaagacaaaaagaataaatgagataatgtgacagtgccttgtaaataccaaatactatatagagatagctattattacttgtatgtttattgtgaacattaatcagccaatcaagttgttcagacttgtactgctgaacatcaattgcagatataacattcttggcagatgacttagtcacctccttctgtggaagaatagaagatagacagctccttgctgtctatcacagtatgttctggtcccgttggcctcaccttccatataatcatttccattctactgggctttagccactctggtgacttgagttcagcaaaaataatctttcttgatgggtggtatatatatttctaccttttatgctttagaatagtttcctttccatttctcatagggtttggatcttcataactgtttgaagagaaatcctgacctccagactgaaggaaagcacaccatgcctttataacgccagcctcggtcttttttttgttcccctctgtcttagttccttttgtattgctataacagaataccgcagactgggtgatttatttatttatttattttgttgttgtcatttgttttcttcttttttgtatcttttgaaattcttttcattgttgttgttgttttgagactgggtgatttgtttattcagctcatggttcttgaggctggaaagcccaagagtatatggtaccagcacctgattatgccatggtggatagacagaacggcaagagagagcttgcttttgtaacaaagtcactcccatgataactaacctactcctgtgataacgacattgcaggttcagtatccctgatttgaaagtctgaaattcaaagtgctcccaaatctgaagctttctgagtatcaatgtgatgctcaaaggaaatgcttattggagtgttttagattttggatttttagatttggtatgttcaacctgtaagtataatggaaatattccaaaatgcaaaatctgaaacacttctggtcccaaacatttcagataaaggatactgaacctttaatccattcatgaaggcagagtcctcatgacccagtcacctcctaaaggcctcacctcttgatactaccacaatggcaaccaggtttccagtacatgaatttttagggggatcattcaaactatagcaccctcctttatcccttaccctattccattagttttaatccccactttgtctcttcctctaatcttcagtctacactgtgacatgataggtatgctcaagtctctaacagctctaaaataacgttttctgtttttttttttgtcttcatttctggtggggttggataagaaaagtttttcaagttaaatcactctctattgcaagcctcttccaccttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcataaaaatatttcagctgggctgggtgcggtggctcactcctataatcccagcactttgggagaccgaggcaggtggatcacctggggtcaggagttcaagaccagcctggccaacatggcaaaaccgtatctctactaaaaatacaaaaattagttgggcatggtggtgggcaccataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcagctgggagaacaatataagcagctgacgtcagggatataaatggctgtgtgttgggaatacaagcagctgattgtcggaaatacaagccactgagtgttggtgatacaagtggctgagcagcgagcagagaatcaggtgagcgttggagactatggatgggacgtggctaacttcagatggtgcagctttggagaataggcccagccggagatggcctggcttcagggaaagatcaccttcttcccataccatccctttttcaactccccattctgctgagaaccacttccatcgtgcaatacaatcttctgcatatactacccttcaatctgttcatgtgatctgattattcctggacactggaagagaacctgggtgccaagaggagagggcaggggctgccaccctgaccctccactgagctggctggcacctggccatccccgaatggccgcgttgaaggagcattgattgtaacacacttggatgctgctgcggggccgcatagagcctgcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttatttacacttctctccttggtcatctttttactgtatttttccctccacagctatttcatccatttctgaggcctgagatttcatccatttctgaggctatagagaccagtgacttcctctgactcttctgagcttgaaattcctattggtaactgccattggacttaactgcctggttatatctctaactaaagtacttctctcttccagcctgtttatcttattgtgttccattgtgttccttatctctaccaatgctagttccttatgctagaaatctcattcattgccactcaatcaagtttgctaaaaacgaaacatctgattgtgtcacttattcaaccttaccaatttttttttttttttgagccttgctttgtcacccatagtggcacgatctctgctcactgcagcctccaccacccaggttcaggtgattctcctgccgtagcctcatgagtagctgggattacaggcatgtgccaccatgcccgactaatttttatatttttagtagagacggggtttcaccatgttggccaggctggtctcaaactcctgacctcaagtgatctgcccaccttggcctcccaaagtgctgggatttcaggcgcctggcctgttacttgattatatgctaaacaaggggtggattattcatgagttttctgggaaagaggtgggcaattcccggaactgaggatccctcccctttttagaccatacaaggtaacttccggacgttgccatggcatctgtaaactgtcatggtgttggcggggagtgtcttttagcatgctaatgtattataattagcgtatagtgagcagtgaggataaccagaggtcactctcctcaccatcttggttttggtgggttttggccagcttctttattgcaaccagttttatcagcaagatctttatgagctgtatcttgtgctgacttcctatctcatcccgtaactaagagtacctaacctcctgcaaatgcagcccagtaggtcttggccttattttacccagcccctattcaagatagagttgctctggtccaaacgcctctgacacaaggattttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggtgttatatataaagttttggtgccgcaaaagaagtagcactcgaatataaaattttccttttaattctcagcaaggcaagttacttctatatagaagggtgcacccttacagatggaacaatggcaagcgcacatttggacaagggaggggaaagggttcttatccctgacacacgtggtccctgctgctgtgttcttcccctactgactagggttagactgcacaggctaaactaattccaattggctaatttaaagagaatgatggggtgagtgctttggcaggagtcagggaagagcaggtagcaggtaactggaatgagggtggagcaggtaatggaaaaacattgctttacgaggaagttaagtttaaaagtagaaggcaaagaattgaacatactggcgtattaattctttgaaatttagaactcacatctaacattggcttaaatgttaaatcctcaaagataacattcctgtttctcctaacacgattaagtccttcttggtatcttttctcatagcaacttgtcctttctcacttgtcacaatttgcaaatatatatttatttacattgtttatttaatgcctaatttccttctttattgcaaggcctgtgagggtactgagtctccagggtgaggtgtataataaatggccaaacgaattgttaattgaaaggatgaacaactaattcaagccagcactctctagactcctggggggctatcatgtgggttccctggtgctgctgatgtcagcccttggcctccaagaaaaatgcttgattcaaatgtcatctagttccatctctacgactctcatggggtccaaagaagagttttaattgagttttagaatttgaagttgtgaagtgtctgaaaaactacatggtgttctgaaagccaaacttttagccttttgggagagcatctaagacagcaggtgaagggcaggggttagaactagagggattgaagaatattatccatataggttagggttaggtttggcaacgtattatagaacaaacattggcaagctacagccacaggccagatctgtctgctacctttccacaaaggtgtaataacaaagttattcacaaatttgtgaataaactttcattggaaagtgaccacgctccttggtttatacattgtctgtggctgctttcacactacagtagcacagttgagtgtttgcactggagaccatatgacccatagagcttaaaatattcagtctggctttttacagagatgtttctgactttgttaatagaaaatcaaaacaactggtttaaataatgcacatactttctctctcatagagtagtgcagaggtaggcagtccagattagtacggtggcttcacgttcatcaaggactcaatctccttctttcttctttagcttctaacctctagcttacttcagggtccaggctggagccctagccttcattctgacagtaggaaggagtaggggagaaaagaacataggacatgtcagcagaattctctccttagaagttccatacacaacacatctccctagaagtcattgcccttacttgttctcatagccatcctaaatataagggagtcagaagtaaagtctttttggctgggaatattggcacctggaataaaaatgtttttctgtgaatgagaaacaaggggaagatggatatgtgacattatcttaagacaactccagttgcaattactctgcagatgagaggcactaattataagccatattacctttcttctgacaaccacttgtcagcccacgtggtttctgtggcagaatctggttctataacaagttcctaataagctgtagccaaaaaaatttgatgaggtattataattatttcaatataaagcacccactagatggagccagtgtctgcttcacatgttaagtccttctttccatatgttagacattttctttgaagcaattttagagtgtagctgtttttctcaggttaaaaattcttagctagattggtgagttggggaaaagtgacttataagatacgaattgaattaagaaaaagaaaattctgtgttggaggtggtaatgtggttggtgatctccattaacactgacctagggcttttgtgtttgttttattgtagaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcgcttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataatagcacaatctaagtgggtttttgtttgtttgtttgtttgttgaagcagggccttgccctgtcacccaggctggagtgaagtgcagtggcacgattttggctcactgcagactcaacccaccagtttcaagcgattctcctgcctctgcctcccaaatagctgggattacaggtgtgtgccaccacactcggctaatttttgtatttttagtagagacagggtttcaccatgttgaccacactggtctcgaactcctggcctcaagtgatctgcccaccttggtctcccaaagtgctgggattacaggcatgagccactgcgcccggccctaagtggttttaatattttgattgacagtatactgaagaaatatactctaagacctttatgaatctcctcattcacaaataacactgtaggatataatggtccctataaaatacggtataactaaaatcagatttttatattggagtacagaacaataaagccatcttcagatgctggtattaaactcactggtgactggtcacaccttgcctaaactggtagccaccatgcatcctctcaccatctccactgtactacttccttccttgggaagtcgggcgctgggaggttgtacaggaaagatacagacccacccttctcagcctctcctcccctagctcgctcttttgccaaagtgacctactgctgagtttcaaagtgacctactgctgagtttcagccaactagcacgtttcagattcataccttagaaaaaattacacattatcacaagtcatgcaccttttaaggtcattttcaaataatagaaattataagtgttcggccaggcatggtggctcatgcctgtaatcccagcactttgggaggccaaggcaggaggattgcttgaggtcaggagttttttttgtttttttgtttttttccccgagacgaagtctcgctcttgtcccgcaggctggagtgtgacagcgcgatcttggctcactgcaagctgtgcctcctgggttcaagcgattcttctgcctcagccccccgagtagctgggattacaggcgcctgccaccacacccggctaatttttgtatttttagtagagactgggttttaccgtgttggccaggctggtctagaactcctgacctcaggtgatccacccacctcggcctcgcaagggctgggattacaggcgtgagccaccatacctggccgaggtcaggggtttgagaccagcctgagcaacatagtaagacctatctctaccaaaaaaaaaaaaaattaactttccaaatgtaggagtctactctgtttccttctagtatttatttctgtatacttttctaacatggttaaaatgtgtaatcaatatgtgtccttttactttggtgtgaacattttttctattataaattcttagaaaatatttctatggctatgagatatttgattcaagtgccttgtaatttacttctcaaatgtccctgatgttggacatttgtttctagtgtttcactattttaaaaaacagtaatatctgtctttatgcttagagctttttcagtttttcaaattatttccttagggtaaaatcctagaagtagaatttttggggcaaattatctacatatttataactgtcttggtattcaaaatctcgttttcaaaaagcttatatcaatttgtacttaacaccagtagtgaatgagagtatctgtcgtaccccaccagtgctgaatttcttttttaaaactgtgctggtttttataggtaaagaaaatgtcttaatttgcatttagttggttactagtaatatcacataccttttcaatgcttgtgaactttaagcttatacagagtttaaccttgcatgttgaacatttgagtgagtggaagtgttaagtgatggccatctgtataatctattagtaatgtatggagaccattaaagatgacaggtatgtgtgatgatgacaggttgttaccaacactcagaaggccaaaaagcaagtgatataaacccatgctgggaagcattcacctcccccactttaaaaatgctagtttcttaattccttttctttatccctttttttgtctgcacgtgtttacttgcctttagtttccctgctttagtaggctgaccttgtgacttttaccaggatcccattatacttttgttcttctgtttatttctcagattttattggagggtggaattctactttttctttcttataatctagaatttacattcagatttcctgcctttcccttacaaaatacctgtgtagttggataggtggagctctggactcagagttctttcttctagtaatcttaggaaattatttaatttttctgtgttttcatattttcacacataaaagagaaaacaccatttctaaactacctcttcttttctctgcttttaagcatgtaaaggttttcccaatcttgggcagtgacatgtacaggacagtatagctttacatctgccttgttttaattaaacactagttctttgaggtaacccctactattatcccagttttatggatgaggcactgaggcaggggtcacacagctagtgtgggtcagaacctaatgggtcagaatggacatttgagtccagagtttggcctggattgacacacatagctattacgtaagattcctctcaaattcagtcctcagctccctgaagtgtgggttctcttttcatgcctccatggaaactgcgtatcatgtggttaccagtttttcctttggtcgtatctgctgacctttttgaacctaattttttctggaccttattgccatttgacttatttattgcctcccacttgacactgattctggcttttgcttttcttcctactttggtcctttttgcagttttctaaagctaaccagccatgactctcagatgatggactttttcgtctctcccattacttcttgggaaattatattttaatctcatggtttaaattttcatccttaaatataacttttaatgtagtatttttagcccagaagggcccatggttggtttgttttctcctttgcatatctcttctactcagatacctggtagcatataaatcaaatgaattatccttcataccatttcattatcatcagtaggactgctttgctggggtttttttgtgtgtgtgtttttgtttttgtttttgtttttgttttgagataaagtcttgctttgtcacctaggcaagagtgctaggattacaggcgtgagccgctatgccaggacagccgttttcttctagtattatttgccctctgtctgaacatcttcctttagtaatgcttttagagcaaggcagctggcctcaatttgttttaatttttcttccccttaggatgttttaattttacctttattactgaaggatattgttactgggcagaaaattgtcttgatattccccttttcagcatttaaaaaatgctcttctgctttctttcagcctccatggtttctcataaaaatcagtcattcgaatcactgttcttctaaaagtaatacattgttttgttctggtcactttcaaaattttctttttcttttcagcagtttaattatgggactgtgtgaggatttctttgttcattctgtttggagttcactgagctttttgaatctctaggtttatgtcttttaccaaatttggaaaatttttcaaccattatttcttcaaaatttttctgtaccacattctttactctttttttttttgaaacagagtggcgcactgcaacctctgccttcccggttcaagtgattctcctgcctcagcctcccaaagtgctgggattacgggtgcctgccaccatgcctggctgattttgttaatttttagtagagacggggttttaccacattgaccaggctggtcttgaactcctggccttaagtattccgcctgcctgggcctcccaaagtgctgggttacaggtgtgagccaccacacccggcccttttttttttttttttttgagaccgagtctcgctttgtcacccaggctggagtgcagtgatgtgattttggctcactgcagcctcagcctcccaagtacctgggattacagagatgtgccaccatgcccagctaatttttgtatttttattagagatggggtttcaccatgttggccaggctggtcttaaacccctggcctcaagtgatccgtctgcctcagcctcccaaagtgctgggattacagacgtgagccaccatgcctggctctttaccctcttctgggagtgacaacacaaataactttttattccacaggtttctgaggctctgtttattttccaatttttttcactattgttctggttagataatttctattgatctgtcttcaagtttcctgaaatttgcattttgttggtaaacctattcagtaaaatgtttttggttattttatttttagttctaaaattcctatatagcccgtctttacatttttttattctgaaacttaaaactttcctttcattttaagagtgtttgcccttacttcttggagcatttttatgctccaaggattttgatatttttgttttattggccaattgatctgattgggctaggtccagccagccttgtcaaagcctttgcagtgttgctcagatctgccccatgtatatgccacccagtcaccagtctgggactggtatagtggtgttctatttgtaattcggttgtcagggtcggtgtgtactgttgaggatcatatccatactcactcaccttgggaatggacccacaagtttataaacagctttaagagattgctttcatgagtttctttctttctgtgatctccatgtggtttcttgggcttcccttttccattcctgcagccaaaagtggactttatcttcctaaagtcagggccaaaatgtgggaggagagagagaaataaagcaagggctatttgccccactctctcgggactgacattcttccagtcagagtaaggattccctccctctgaattttaggcttctgccacccacattaccatcaccacaggattgtgtgaggactgggcatacgagaatggagaaaagcggaaaagaatgccgggtgtggtggctcacgcctgtaatcctaacactttgggaggccaaggcgggcagattgcctgagctcatgagtttatgaccagcctgggcaacacagtgaaaacctgtctctactaaaatacaaaaaattagccaggcatggtggtgggcacctgtagttccagttactcaggaggctgaggcaggagtattgcttgaacccgggaggcagaggttgcagtgagccaagatcgtgccactgcactccagcctgagctacagtgcgagactctgtctccaaaaaaaaggaagaaaaactggatttttacactgtctgggtgttaggagacctctttcctgatcctcaagccagaactagaggtcttctggagctcccattgtcttgctaatgcccactcatgttgtaatgagcacaggtggaggaaaaaaagtggtcagctcactgctagtacttctaattccccagcccacctacctctcattacttttcatcttttgcaaccagctgctgcctgctttctgcccaggttttgtaactgtattcagtgggatagagagagtggaaggtacttactccatcttatctggaacctttcttaatatattttttgtcgcatttgtacatcttttatccatccttcattttattttatttttttttttgagacggagtctcagtctctcgcccaggctggagtgtagtggcatgatcttggctcactgcaacctccgcctcctgggttcaagtgattctcctgcctcagcctcccaagtagttgggattactgggacacgccaccatgcctgggtaatttttgcatttttagtagagatgagggttccccatgttgcccaggctggtctcgaacttctgacctcaggtgatccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatatagaaacaagttgtttactttgacacccagtataactaaaaggatcttttgagtcagagattgagtaacttgccagagcctgtttggaaataaaccctgaggatttttcatatcagtggttggttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataaaacagcagggctgttttctttcataccctttagcacaggaaagctgaactagggatttttgcaagatgagaaaggcctgttgaaatgtgtgtgtataacatagtaataaaagaaatgcatatgaaaataacaaattaacatatttgacatattgactttgtcaagattagtcttttttgtcaagtaactaagccagtgtgtattaattaaatcagtaattagaaaaagtttgtacactttgatttagtaattttgcttttatgatatattctaaagaaggaattagaaatgcagaaaaatatttgtgaagtaggatgttcattttaatgtaaattaaaattggggaaagaaagggaaaacaatacagattccatgcataaggcaaaggttcaattgtgggtttatccgtatgagtagactattattttgtcatttaaaaatcatagtttcagctgggcgtggtggctcacgcatgtaatcccagcactttaggaggctgaggtgggcggatcacctgaggtcagaagatcgagaccagcctgaccaacatggagaaatcctgtctctactaaaaatacaaaaaaattagctgggcgtggtggcgagtgcctgtaatcccagctactcaggaggctgaggcaggagaatcgcttgaatctggggagtggaggttgcggtgagattgcgccattgccctccagcctgggcaacaagagcaaaactccatctcaaaatcaatcaatcaatcagtcaatcaatcatagtttcacgccaggtgcagtggcacggacctgtagacccagttacttgggaccctgagacgagatgattgcttgagcccaggttttccagtctagcctgggaaacatagtgagaccccagtctcttaaaaaaaaatcatattttcaaataatatttggtggcatgagaatatgtttgtaataaaagattacatttgtgaaagcagaatgtaaacagtacactagttgattctcactgttaaggtctttacacacgcctatacgtgcagatagaaaacatgtctgaaagggaaacggttttattttgtttcgtatttttttttgagacaatgtctcactttgtcagtcaggctggaatgtagtggcactgtctcggctcactgcaccctatacctcctgggttcaagcaatcctcccacctcaacctccatggtagctgggactacaggcacctgccaccacgcctagctaatgttcgtatttttagtagagacggggttttggcatgttggtcaggctggtcttgaactcctgacctcaggcaatccacctgtctcagcctcccaaactgctgggataacaggcgtgagccactgtgcctggcctgaaagggaaatgttggtattaattttggttgtcactggcctttagaatagttttcttcttttagtgtttctgtgtttcttaagtgttacaagcatatgttacttttgattcagaaaaatgctatttttaaaataagcaagactgggcacggtgactctcaccagtatggctgagaccagaggatcacttgaagccaggagttcaaaaccagcttgggcaacagagtgagacccccacctctacaaaaagaaaaaaaaaaaattaaaaaattagccaggcatggtggtgtacccacgcctatagtcctaggtactagggaggctgaggtgggagtatggcttgagcccagtggttcgagattgcagtgagctacgatcatgccactgtaccccagcctgggcaacacagtgaggccctatctcaaaaaataattaaaaaaaaaatatttgggggctcctagaaggtacagttaaaaaaattaaaattaggccgggcatggtggctcacgcctataatcccagcactgtgggaggctaaggagggtggatcacttgagatcaggagttcaagaccagcttggccaacatggtgaaacttcatctctaatacaaaaatcacctgggcgttggtggtgggtgcctgtaatcccagctactcgggaggctaaggcaggagaattgcttgaatctgggaggtggaggttgcagtgagccaagaccatgctactgcactccagcctgggcgacaaagtgaggcttcatctcccaaaaataaataaataaaattaaaaaaagaaataaataagaacatctccttcttcctttgccaaaaaaccgaggtgaaaagcatctctcaagaatgatgagaatttcaattatttaatatttactctggtccttaatttaaagcttaatatggaatcccagtgtacatctcccactggtattgtttgtcttggccaagacagacaagttttaaagagtgagataaaatttaggctaaagttgaagtatttggagggaaatgtacagatgttctcagcttaccttttttgtttttttgagatggagtctcgctctgttgctcaggctggagtgcaatggtgcgatctcagctctccacaacctccgcctctcaggttgaagtgattctcctgcctcagcctcccaaatagctgggactgcaggtgtgtgccactatgtctggctaatttttgtatttttttttttaatttattttttattgataattcttgggtgtttctcacagagggggatttggcagggtcataggacaatagtggagggaaggtcagtagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaaacacatcttgcaccgcccttaatccattcaaccctgagtggacacagcacatgtttcagagagcacagggttgggggtaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggtgcccctcacctcccgggcggggcggctggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctcccagacggggcggctggccgggcggggggctgacccccccccacctccctcccggacggggcggctggccggccggggggctgaccccccccacctccctcccggacggggcggctggccgggcggggggctgacccccccacctccctcccggacggggcggctggccgggcggggggctgacccccccacctcccgtcccggacggggcggctggccgggcagaggcgcccctcacctcccggacggggcggctggccgggcggggggctgacccccccacctccctctccgacggggcggctggcctggcagaggggctcctcacttcccagtaggggcggccgggcagaggcgcccctcacctcccggacggggcggctggccgggcggggggctgacccccccacctccctctcggagagggcggctggcctggcagaggggctcctcacttcccagtaggggcggccgggcagaggcgcccctcacctcccggacggggcggctggccgggcggggggctgacccccccacctccctcccggacggagcggctggcggggcggggggctgacccccccacctccctcccggatggggcggctggcctggcggggggctgaccccccccacctccctcccggacggggtggctgccgggcggagacgctcctcacttcccagacggggcggctgccgggcggaggggctcctcacttcccagacggggcggctgccgggcggaggggctcctcacttctcagacggggcggccgggcagagatgctcctcacctcccagacggggtcgcggccgggcagaggtgctcctcacatcccagacggggcggcggggcagaggcgctccccacatctcagacgatgggcggccgggcagagacgctcctcacttcctagatgtgatggcagccgggcagaggtgctcctcacttcctaggtgggatggcggccgggcggagacgctcctcactttccagactgggcagccaggcagaggggctcctcacatcccagatgatgggcggccaggcagagacgctcctcacttcccagacggggtggcggccgggcagaggctacaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgtgagtctgcaatcgcaggcactcggcaggctgagtcaggagaatcaggcagggaggttgcagtgagccgagatggcagcagtacagtccagcttcggctcagcatgagagggagaccgtggaaagagagggagagggagaccgtggggagagagagggagagggagagggagagcgcttaaaacaatttttaagatgtatttcttttctcatagttccagaggccagaagtcccaagtcaagggttggaagcaatttttgtatttttagtagagatggggttcaccatattggccaggctggtcttgaactcctggcctcatgatccgcctgccgtggcctcccaaagtgctgggattacaggcatgagtcactgcgcccgatctctcagtttactttgatatgtattaataataacaaagactaatggatgaggagctagacagaaattttataaaccaagtactgcaaaatatgaatggtagactctaggtgatatatgggtgttcactgtaaaattaattaaattttgctgtgtgttcgaacatttttgtaacaaaatgttggaaaatttttgtggaagaacaccagaaacaactttgttgtatctggatataatttagaatattcaaatgttggctaggtgcggtggcaacctgtaatcctagcactttgggaggccaaggcaggtggatcacctcaggtcgggagttcgagaccagcctgaccaacatggagaaactgtgtctctactaaaaatacagaattagccaggtgtggtggcacatgtctgtaatcccagctacttggggggctgaggcaggagaattgcttgaaccctggaggcggaggttgcggtgagccgagattgcgccattgcactccattctgggcaacaagagcgaaactccgtctcagaaaaaaaaaaagaatattcaaatgtccaaggagtaccaatatctaggtaaagccattctgttggcctttgccaaattgtactattttataaagttgttttaaagagagatgtgggccgggcatagtggtgcacatctgtaatctcagcactttgggagtctgaggcgggcggatcacttgaggtcaggaatttgagaccagcctgggcaacatggcgaaaccctgtctctactaaaaatacaaaaattagcctagcgtggtggcgcgcacgcgtggttccacctactcaggaggcttaagcacgagaattgcttgaacccaggaggcagaggttgtggtgagctgagatcgtgccactgcactccagtctgggcgacaaagtgagaccctgtctcaaaaaagaaaaaaaaaatctgtactttttaagggttgtgggacctgttaattatattgaaatgctttcttttctaggtcatccatgcctggcttattatatcatctctattgttgctgttctttttttcattcatttacttggggtaagttgtgaaatttttggtctgtctttcagaattaactacctttgtgctgtgtagctatcatttaaagccatgtactttgttgatgaattactctgaagttttaattgtttccacatataggtcatacttggtatataaaagactagtcagtattactaattgagacattcttctgttgctccttgcttataataagtagaactgaaagaacttaagactacagttaattctaagcctttttgaagattatatagtcttctagtagaagtctgtgcatcagaatgttttaagaaagggttttaagaatgtataaaaaccaaaataattgattttcatacttctatattgttttttatcagtgactcttttttctttcaaatgaaatcttatatgaaattttcatatataatatagaaaaaagtggatctagtctgtcaaagagaatagtgaagctcagagatgtgccagcctggcctttttctcagctcaagtggcagaatacagtttgtaaacaattgcactagctcttaaattcgaagaggcagtcaaactaataaataaattggagagttatttctttggtagaggattaagggaaataaccacagacagaagaagcaaatatgagaatctatgtgaaatggatgatattctagaaaaaaaattatcaaaactgacccctaaagagagaatatctaaacagagtaaagaagaggtacagaaagttactgaagaagtttccaccccacctgcacaaataacaatagtaccaggccccagtggattaatggggaaattctgttaaacctttaaggaatggtaactctaatactaagtgttccgaacatataaaaagaaaaaaagcttccagattaattttatgaagccagcataacattaataactaaagccctgcaagttatcaagtaaaagaaaactattggtcggttatatttattgatttcaaaagcataacagaatattaagagaattcagcaatagatgaaaagaataatactttttttttttgagtctcacgctgttgcccaggctggagtgcagtggcatgatctcggctcactgcaacccccacctcctggattcaagcgattctcctgcctcagccccctgagtaaccgggactacaggtgcgcaccaccatgcccagctaatttttgcatttttagtagagacagagtttcaccatgttggccaggatggtctcgatctcctgacctcgtgatccgcccgccttggcctcccaaagtgctggaattaacaggcctgagccaccgcaccctgccataataatacatttgaccaagtggagtttgtttgcagaatcgttcattataagttgccatattactagatcatcatctctgtatgtgctaaaaggcatttgataagattcctgttcttgatcagattccttaataaatagacggggtcgggtgtggtggctcatgtttataatctcaatactctgggaggctaaggtaggaggatagcttgaggttgaaagttggataccaacctgcgcaacataacaagactttgcctctacaaaaaataaattagccagttgtggtgtgtgcatgtagttctagctgcatgggagactaaggcgggaggatggcttcagcccaggaattcaaggctgcagtgagctatgattgcaccactgcaccccaggctgggtgactcagtctctaaaaataaataaataactaaatctctaacattataaaatgtatgcatctcattctaaaggccaatgtcatcctcatagggaagctagaagcttgcctattaaggtcaggaatgagatggaggttttcttttctttcttttgtttgtttgttttttgttttgttttttctgagatagagtctcactctgtcatccaggctggagtgcaatggtgtgatctcggctcacaggaacttctgcctcctgggttcaagcgattctcctgcatcaaggcctcccaagtagctgggattacaggcacctgccactatgcccggctaatttttgcatttttagtagagcaggggtttcaccatgttggccaggctgttctcaaactcttgacctcaggtgatccacctgcctccgcctcccaaaatgctgggattacaggcgtgagccactgtgcctggctgagatgaaggttttctttatcaccaattatctagcattgctctggagggactagcaaacacaattaaacaggagaaagaaatacgaactatataatttggaaaagaaggttaaattaccaatatttggagataaaatgattgtttactttgttttagaactaactgaaaaccaattcaaattactaagtaagtttggtaaggcaattaattgattacaaaattaaacaaaagtcccctgtctgggtgccgtggctcatgcctgtaatcccagcactttgggaggccgaggcgggtggttcacctgaggttaggagtttgagaccagcctggccaacgtggtgaaaacccacctctactaaaaatacaaaaaattagccgggcgtggtggtgggtgcctgtaattccagctactctggaggctgaggcaggagagtggcgtgaacctgggagatggaggttgctgtgagccgagatcgcaccattgcactcccacctgggcaacaagagtgaaactccatttcaaaaaaataaagtgaaaacacaaatcaataaccttcacataaacaactagttagaaaacataataaaaggataagtcccatttatgatagcagcaaaaaagattaaatatctacgagtaaacaagaattgtgcaagccctggacactggtgaagcagagatgccagctgaggtcctgcccccagctccccttaagctgagcagtgtggagaacatcttgcacaggctgctgactgccttccaagaagcccttgacctttaccatgtgttggtctcccttgaccgggtgggcactgagcagtagcaggtgtagactgagctggcctctaacttcctttggatccacagccagttgtaggccaacaacggggtggaggggtctgatgtggctccaggccctctccagctcaggttacccctccttatgtacattgtactcagagctgctagtgcaggctgtgcagaggaaggcaggggacactgaggtccagcagtccctgctcctgcttctgaagaaatagatattttaagtgaataaactgacagcttagaggggtaaaaaagataatatgcaagatctattgagaattttaaggctgggtgtggtggctcacacttgtaatctcacctatttgggaggccgaggtgggaggatcctttgagcccaggggttctagaccatcctgggcaacatggttgaaactccatctctacaaaaaatacaaaacttagccaggcgtggtggtgcatgcctgtagccccagctgcttgggaggctgagtcaggaggatcacttgagccaaggactttggggctgcagtgaactgtggttgtgccctctatccagggtgacagtcagaccttgtctctatttaaaaaaaaaaaaaaaaaaaattaaaatatgctatcatttgtgtcaagtagaaaagtatatatatgacatgtatagactttctggaaggatgtacatgaaattaatagtagtgctttccaatcaggcacggtggctcacacctgtaatctcaacatttttggaggtggagacaggaggactgcttgagcctaggagttcatagccagcctgggcaacatagcaagaccccatctcaagaaaaagtagtgctttcctctaaagaggggaaccatggggcacagtggggagaaaacctacttttcacagtatctgttgtgaattttatatcttattcatgtgttacctggccaaagattaataaatagattgtttttgtttttgttttttagtttgaggatactggaaatgcttaatataaatatctacatcgtccagaaatttcaatgtttactctattttggaatttcaaagtgggagaggaatcatctttttggatggtacctgaaactgaaagtttatgcctaaaggcgtgcttgctttctcctcagttacctcaggcatcttctacagttgcaatctctttgttgttagatggtggattttgcctccccagaattaaaatagcattttcttcattataaaaatacttaacattcattgtttttttaaaaaagacattatataagattataaagaagaaaaatgaccagattcccaccacctaaagataagtcctgtcatcctttcaggaattaatatatcaatttctcatctactcttctctcacactactttgcataaatgggatcataaatgggatcctatattttttcaagcaacagtgtgttatgcctatactccatgtttatatgtgtgtattaaaaaatgtatttgtatatatgtgtatgtataagtgtgtgtgtgtgtatgatgattcttctcccgctttgaaggtgaaagaaagcacacctttatttaagcataaactttgggtttcagatactgtctggaaaaatgatttatctcccactttgaaattccaaaatacgtacatatattttttttttcttttcttttttagttttagggtcttgctgtgttgcccaggctggagtgcagtagtgtgatcatagctcacacagcctctaactcccaggctcaagctatcttcctgccccagcctcctgagtagctgggactgcaggcatgtgccatcaactttagctaattttaaaatttttttgtagtgatagagtctcactgtgttgcccaggctcgtctggaattcctggcctcaagtgatcctctcacctcagcctcccaaattgctgggattagagtgtgagccactgtgcctagcctgcatatatctatttttaatgactgctaaatctcattgtatgaaaatttatgtcctagctataaaatttgttagcacatgtttaattttttctaatttcagatgttttaaactaatatttcccaaagtatagtatggcattttaggtatgatatgatcttttttcctcttcgtactcatttttatagttatggcctgtgcaactggtttcccatttatatgaatgatacagagcttcctattaagaaaaagttcagcttgggaaaaaaaaagtgaattgttcaacttgagggaaaaaagtgaattaattggccaggcaccgtggctcatgcttgtaatcccagcactttgggaggctgagacgggtggattgcttgaacccaggagttttagaccaacctgggcaacatgttgaaaccctatctgtacaaaaaaaattagaaaaattagctgggcatagtggcacacacctgttgtcccagctacttaggaggctgagctgggaagaccacctgatctccggaggtaaagactgcagtgagccgtgattgcaccactttactccagcctgggcaacaaaatgagaccctggctcaaaaacaaaaacaaaaacaaaaaaagagtaaattaatttaaagggaagtattaaataaataatagcacagttgatataggttatggtaaaattataaaggtgggatattaatatctaatgtttgggagccatcacattattctaaataatgttttggtgaaaattattgtacatcttttaaaatctgtgtaattttttttcagggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatggtaaaacccaagactgataatttgtttgtcacaggaatgccccactggagtgttttctttcctcatctctttatcttgatttagagaaaatggtaacgtgtacatcccataactcttcagtaaatcattaattagctatagtaactttttcatttgaagatttcggctgggcatggtagctcatgcctgtaatcttagcactttgggaggctgaggcgggcagatcacctaagcccagagttcaagaccagcctgggcaacatggcaaaacctcgtatctacagaaaatacaaaaattagccgggcatggtggtgcacacctgtagttccagctacttaggaggctgaggtgggaggatcgattgagcccaggaggtcaaggctgcagtgagccatgattgcatcactgtattccagcctgggtgatagaacaagaccttgtctcaaaaaaaatttggtttttcaagctttttgaggttttgacaagctggccaatatggtgaaaccccgtctctactaaaaatacaaaaattagctgggtgtggtggcgtacccttgtattcccagctacttgagaggctgaggcaggagaattatttgaacccaggaagtgaagtggaggttgcagtgagccgagatggtgccactgcactctagcctgggtgacagagcgagactctgtctcaaaaaaaaaaaaaaagcaaaaaaaaaaaagcacaagcagagtggtagacacacaaaatgctcaattcattttttaaacgatttttttcctttatatcttactgcagaagcttttttcttttttttgagacaaagtcttgctgtgtcacccaggctggggtgcagtggcacagtcatagctcactgcaaccttgaactccctggctcatgcgatcctcccacttcagcctctcaagtagctagaactacaggtgtgcaccaccatgcctgactaacttgtttattttttgtagagagaacgtcttgctatattgcctaggctggtcttgaactcttgggctcaagcaatcctcctaccttggcctctcaaggtattgggattataggtgtgagccactgcatctggcctcaattcacttttaaaatcaaaattaggttacctactttttataaggtaatgtatagaattattcttttaaaaataaaaccgatttggacagtgtgagattcacattctgtaaccaccagtgtgacatgggtcctgaacagttagaacatactccagccattaacccaggcagctttcaggtacgtactctgtggctgttgccttgtatgaaagccaaaaagagatccattttcagagattaatatgtgaccccttctatattataaggccatggccatactcttttttttttctttttgtttttttcttccaaagacaggatctctctctgtcatccacgctagagtacagtggcatgaacgtggcttactgcagcctcaaacccttgtcctgggctcaaacaatcctcccacctcagccttcaaagtagatagaactacaggcatgcactaccatgcctaattttttaaaaaaaaattttttttcagagatgagatctcactgtgtttcccaggcttgtccggaactcctggcctcaagcgatcctcccaccttggcctgccaaagtgttgggattacaggcatgagccaccatgcctggccatacacttttttttttttttttttcaagacggagtctggctctgtcgcccagactggagtgcagtggcgtgatcttggctcactgcaagcttcgcctcccaggttcatgccgttctcctgcctcagcctcccaagtagctgggactacaggcatctgccaccacgcccggctatttttttgtatttgtagtagagacggggtttcaccatgttagccaggatgatctcgatctcctgacctcatgattcacctgcctcggcctcccaaagtgttgggattacaggcatgagccaccgtgcccggcctggccatacacttttgtcattatttacatacttactaaaatgtttggtggcctgtaataggaaacatcatcctcatttgattgacgaagaagtctgtggaaataggattgaactggttctgttcttgtatttgagtaatcagttgtggaactatagaagtcatatactctctctgactttcataattaccttatgttgtatagtacttgatggtttgcaaagtaaccatctattcttgcttagctgtgagtaagaatgccaggtctggagacagaatgtctgggttcaaattctactcatcactttttatttttattttttttgagatagagtctcgctttgttgcccaggctggagtgcagtggcgtgatctcagctcactacaacctctccctcccgggatcaagcgattctcctgcctcagccttccgagtagctgggactacaagtgcgcaccaccacgcccagctaatttttgtatttttagtagagacgaggttttgccatgttggccaggctggtctcaaactcctgacctcaagtgatctgcctgcctcagcctcccagagtgctgggattacaggcttgagccactgcgcccagcctactcatcacttactagctatttgaccacacaagttactcaactcctatgtcagttatgaagattaaattaaatgatccatttaatacaataatacacttagaacaatgtctatcagtaaatttttttctgttttaagaaacaggatctcactctgtctcccaggctggagtgaagtggcacgattatagctcactgtagcttcaaaagcctgggctcaagcagtcctcctgtctcagcctcccgagtagataagactacaggcacaggttggtgttgacctcctagcctcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcctaaactctgatctcgaatctgaatcccaagtccaatattcttttcaccgtattacaatatttttaccatcaaccctccattctgtctgcacatcatacaaatgagtatctctacagagctttgagttgcttttaaacaaaagagatttttgtacccaatgtttagagtagtgattctcggctccatttttacaagatttcaagatttaatttgtcaaaaaagttctgaaattttcaaagcaaaagcaattttaatttaattgctctaaaaaataagcagatttatcatttagcaattctttaagggagagtgtatcataaaactgaaatagtactgaatgtggcagaatcaaacaagttgaaaatctcatcacttcagagcagggcagacttctcattcaaacaaattgaggtagaagtggtgagagtagagatttctttgtgtatgtgtgttttattactgtactatattatattatagttctatatatactatattatattgtacatatatattattatatgaagagacatgaccactttgaggcatgaaatttttttttttttttttttttttttgaggcacggtcttactttgtcacctaggcagtggcgccatcttggctcactgcagcctccacctccagggctcaagcaatcctcccacctcagcttcctgagtagctgggactataggcacctgccaccatgagctgctaattttttgtatttttggtagagacggggttttgccatcttggccaggctggtctcaaactcctgagcacaagtgatctgctgcctcagcctccccaaagtgctggaattacaagcataagccactgtgcctggcaagacatgaaatttttaaatgtaaatgcatttaagtgacaataatgtgaatacaagttatcaattcttcctttacaagtttagctatacctgttttatatttttcagtgtttaaaattatttttatatttttatattctgaattttctttctttctttcttttttttttttttttttgagacggagtctcgctgtattgcccaggctggagtgcagtggcgcaatctcggcgcactgcaagctccgcttcccgggttcacgccgttctcctgcctcagcctcccgagtagctgggactacaggcacgcgccaccacacccagctaattttttgtattttttagtagagacagggtttcaccgtgttagccaggatggtcttgatctcctgaccttgtgatccgcccacctcggcctcccaaagtgctgggattgcaggcgtgagccactgcgcccggcctatatgctgaattttcatgacagagaatgaaagaaaaagtgcagttgatcgaaagaaatggtggtataaacaggaataacaggcatgttgtttcctctctgatttattatttttgtaaaataagctacttttcagcaccacatacatatgttctgagacctgaatatttgtgaccaaagagtaaagaagtaataaactttatctcgcaaagagttattattgtgttttatttaaatttactgccctcttacttcaagtacttctcagtagtacgtaatactgcttttaaaaaggagaagggatgaatttcttctactctgctcttcatattttgaaaagttcagtcaaatcccctttattaaattcatctcagagtaatctttttaatttgtagttcatatccgtgattagtttagaagtgacttctccctgtttctgctcactgtaggttgacaactgcttaaaatagtctatctcatcattatctctgcagctttcctttaaactaggaagacttgttcctataccccagtaacgatacactgtacactaagcaaatagcagtcaaacccaaatgaaatttttacagatgttctgtgtcattttattttgtttatgttgtctcccccacccccaccagttcacctgccatttatttcatattcattcaacgtctttttgtgtaaaaagagacaaaaaacattaaacttttttccttcgttaattcctccctaccacccatttacaagtttagcccatacattttattagatgtcttttatgtttttctttttctagatttagtggctgttttgtgtccgaaaggtccacttcgtatgctggttgaaacagctcaggagagaaatgaaacgctttttccagctctcatttactcctgtaagtatttgagaaggatattgaattagtaatcagtgtagaatttatcggaactgaagcacatgtaactatggtcattttcatggtacttgttctcatcttaaatgcacagcattcctggaactcctgcagatctctttgtttccttgcaagcaattgtcttctacctgatgttgattcaagagagttttcaatatgaatagaaagaaagaaaatgtttagatattggggaaccagcattcccattttaaaacctgttaggagttgttgattagggcaagctcaaggattcctttgagtgactggtttagatgtctttctgctattcggtgaccactggggaactgagattgttgagcagaagggtaatgtgagcagagccgtgcctttgtaagctggcagcactgtgtgagatgaattggtgggttggatactgagatcatgagaggcatactaagcataattaagatgatattgccatgatctaggtggaaagtaatgggggtttgaattatggtagtggcagtagcaatcaagggaaagagttgatcagaggattcagaggtagaatcaatagttctagcaactgaggagagaagttgtaagcttgaaggaaaggtgatgaagaaaaaatgctttcctgtgttttcttgttgttgttgttgagatagggtctcactcccatccaggatggagtacagtagtgtgatcatggctcactgcagcctcgacctcccaggctcaggtgatccacccacctcagcctcccgagtagctgtgactacaggcacgcactaccaggcctggctaatttttttgtgttgtgtgtagagactgggttttgccatgtgcccaggctggtcttgaactcctcggcttaagcgatcctcctgccttgacttcacaaagtgcttgagttacaggtgtgagctaccacgcctggccatgttttcttgtgtgaaggatctgtttagttttatatctttctgtggctcatatctaatttagttgacagtacctgtgggtcactaggtagacattgctagcagacgtttagaaatgaaatactagagcttgggaaaaagttgatatttgagatagagacttgaagaacattagcagagagttggtagttaaggtctgtgagctggtgagcaattcaaataaaagcagaagagaagaggaagacaagggtcaaactttgtcaactactgtgtttagagaatgagacaagagaggatactacaggaagtagaggaaaatagtggaaaattgggcaagccagtatttttcacttaagaatatcattactgttttttgatgtcagcacatgaaatggctgcatagtgttctcttacgtagatattcagtggtgggtatcctcattgatagacatttagatcatttccatttattttctatcacagacagcacttacagagtgcatccatgaacttatgaatattattataaaatgtattcttacagtagaattgctaagtcaaaggatgtatttaaattttgatagtttgccatattgcctcctaaaaaagctgtgcctgtttacattcccttcagtaatatgaaagtatcaatttccttacccctttggtgttttggtttgttttgttttggagactgagtctcgctctgtcatgcaggctggagtgcagtggtgcgatctcggctcactgcaacctccgcctcctgggttcaagcagttctcctgcctcagcctccggagtggctgggattacaggcgtgtgccaccacacccagctaattttttgtatttttagtggagacacggtttcaccatgttgaccaggctggtctcgaactcctgacttcaggtgatccgcctgcctaggcctcccaaaatgccaggattatagctgtgagccaccatgcccggccactgctttgttaatgcttgcctgtgtctgtgcatacatgcatgtgtgtgtgtctgagagagaaagagatctaataggcaaaaaaataacatcttgttttattttttattgtttgtctaatgctttgggtgattatttgaactttttttcatgtgtttcttagttacagatctgaatttattttgtaactggcttggtataatctttttcatatttgtgaaattaatcttttttgtgtgtgtgtgagacagtctctctctgtcacccaagctggagtacagtggcgcaatctcaactcactgcaacctccatctcccaggttcaagcaattctcctctctcagcctcccaagtagctggaattacaggcgcatgccaccacgcctggctgatttttgtatttttagtagagacgggatttcaccacgttggccaggctggtctcaagtgatccaactgcctcagactcccaaagcattagtattacaggtgtgagccactgctcccagccctgtaaaattaatcttaattatacaagtaattcattatccttgaaaaaggataaacattacagataaaaataaatttcacggtaactatcatctctaatcttaatgccttatcaagtacttacccctgttgtcagtttgttgtatatccttgtagattttttttgccaatttttctgttgagttactggaaaagcagtttcaagaaggagagaggctgggcgtggtggctaacacctgtaatcccagcactttgggaggcctaggtgggcggatcacttgaggtcaggagtttgaaaccagcctggccaacatggtgaaactctgtctttactaaaaatataaaaatcagctgggtgtggtggtgcacacttgtaatcccagttacttgggaggctgaggtgggaggatcacttgaacccaggaggcggaggttacagtgagccatgatcgtgccactgcactccagcctgagtgacagcaaggcttcatccccaccctcccaaaaaaagagaatatctttttgtttgtttgtttgtttgtttgtttgtttgtggcagagtcttgctgtgtcgcccaggctggagttcagtggggcgatctcggctcactgcaagctccgcctcctgggttcagccattctcctgcctcagcctccccagcagctgggactacaggcacacgccgccacgcccggctaatttttgtatttttagtagcaacggggtttcaccatgttagccaggatggtctcgatctcctgaccttgtgatccgcccgcctcggcctcccaaagtgctgggattacaggcgtgagccaccgcgcctggccgagaatatcattttttataaagaagtcaaaggtaatgaggactaagtaaaaccatacagtatttgctgtctaagatgtcattagtgacattgaagagagcagtttcagtagagtgatagaaccagaagcagtactccaaagggaaggtgcgtatgtgtgcatgcatgtctctgtgttttgccagtgctggcagtggaagtgatggtgtaggcagagaatgggtggtgaagaaggagaggtatagtaaatgtcatgtactacatcaaagattcctgtctcacaggcagagcaggtggtgacctgacaggagaacaggtttcaggaaaggtgtttcaaggagagggaaggttccattttattttatttatttattttttttgaaacagagtcttgctctgttgctcgggctagagtgcagtggtgtgatcttggctcactgcaacccccgcctcccaagttcaagcaatggtcctgtctcagcctccggagtagctgggattataggcacccaccaccacatccggctaatgtttgtatttttagtagagttggggtttcgccacattggccaggctggccttgaactccccacctcaagtgatccacctgcctcggcctcccaaagtgctgggattacagacgtgagccactgcacccgacctgttttattttatttttgaggtaagtcttgctctgttgcccaggctggagtgcagtggcgcaatctcagctcactgcaacctccatctcctgggttcaggcaattctcctgcctcagcctcccgagtagttgagattacaagcatgcgccactatacctggctaatttttttttttccatatttttagttgagccacaggttgggagaagggaaaatacattctactcaaagtgagtccgtggcaaaagtgtgagtacagagatgggtgaggaattaggaccagactttcagtctgcagcaacattaaacatgtatgttaatttaatactcagaaagaagcatttactctgttttaaaatatctatcacatactatatatatatatatatatatatatatatatattttttttttttttttttttttttttttttttgagacagtcttgctctgtcacccaggctggagtgcagtagcgtgatctcgactcactgcaagctccacctccccgggttcacgccattctcctgcctcagcctcccgagtagctgggactctaggcgcccgccaccatgcctggctaattttttgtatttttagtagagacggggtttcaccgtgttagccaggattgtctcgatctcttgacctcgtaatctgccctcctcggcctcccaaagtgctgggattacaggcgtgagccaccgtgcccagcctatcatatataatatttttaaaactcaacgtctgtgctcgctttagcagcacataatagtaaaattggaatgatacagatgatttgcatgtatttttttaaaagttctcaagtctatttaataaccacagaatatgagacattctgagatgttttagaaacagttcaacatatgtgggaaaataggagtataaacccttacctcctgtgtagatcaggtaggttcaagattgcatctgttcttttgtaatactaaatgtctggtgaagatttgaggattttatataaatcattgagtttgagaggtttttttgtttttgtttttgagatggagtttcactcttgttgcccaggctgaagtgcaatggcacaatctcggctcactgcaacctccgcctcccaggttcaagcgattctcctgcctcggcctcctgagtagctgggattacagacgcctgccaccacgcccagctaattttttgtatttttgtatttttagtagagagagggtttcaccatgttggccaggctggtctcaaacttgtgacctcaggtgatctacccgcctcaccctcccaaagtgctgggattacaggcatgagccaccgcacctggccttcgttttgttttttcaacagaatgtaagaattttttcttacatttttcttacatttttaacagaatgtaagaaaaccacaacgcaatgccgatgagtactttttccctgaagtggatataagcatgaatataaaaagttttaaatcagtcatcctggctatttgttctctaaaaatcaataaataattctttcatgcattttaatactgtctcccagttaagggtattcagtttgcaaaatgctcttactgacaggaaatgtatgagcatttttgttttttacttctgtcgtttgacagaaaaaatatacacctactctttgagctaatttattcttacctagtggtcattagtagaagtggttcactctgggagcttaactagaagggaaactaacaattccttgaggtagatcattttatctaaagctttttgatttcatatcagttgggggcgggtatattatgttaatttttaaatctgcatattttccagccaggcatgactataatcccaggactttgggaggtagaagcaggaggattgcttgagcccaggaattcaagaccaccctagactacattaaaaaacatatttttttgtatttattttttattttatttttttgagacagagtttcgctctcattgcccaggctggagtgcaatggcacgatctcggctcaccacagcctccgcctcctggattcaagcaattctcctgcctcagcctcccgagtcgccgggattatagacatgcaccaccacaccgggctaattttgtatttttagtagagacagggtttctccatgttggtcaggctggtcttgaactcctgacctcaggtgatccacccacctccgactcccaaagtgctgggattacaggtgtgagccaccatgcctggcctttttttttttttttaatttaaacgaaatctgcttattttcctgttgatgtaaggtgtttgtgttaaggtgaaatgaaaagtgatttttaaaaaaatattattttaggactatttaacaaatatactatttatgataattaacatggggttagcaaactactgcttgaagccaaatatggcccatggcttgtttttgtacagcttataagctaaaaatgctttttacatttaaaaaaaaaaaaaaagaacaaggaagaatatgtgacacacaaaacctgaaatgtttactccctggccatttacagaaaaagttagctggacattgattttcatgttactattaactgctaaaacaaaggagcttgtagctatattttttcatacttgcataaagaaagaaaacctaataaatcgctggtggcttcatttccaaaaggctatggaaatccataaacaggctgggtgcagtggctcatgcctgtaatcctagcactttgggaggctgaggcgggaggattgcttgagcccaggagtttgagtctggcctgggcaacgtagtgagaccctgtttttagaaaaaatgaagataaaaaactaatccataaacctcatacttggtggttgcccttcagtttttcttctttagatctggatttagttaaacagtgtattgcctgcctggtttctgttaacttttgatcatttggttgggttatcctataatgaaacttggttgacctcagaaataacaaggtggtcgttcagcttctttgattgtgtgtttctttcataagttcttcaagaagcctgagtattagaaacatggataaaattattgtgataaaaagccagagagacataaatgtcaagtatcttgtttaaaattactgtgaccaggccgggcgtggtggctcacgcctgtaatcccagcactttgggaggctgaggcgggcggatcacgaggtcaggagatcgagaccatcctggctaacacagtgaaaccccacctctactaaaaaaaatacaaaaaattagccaggcatggtggcgggcgcctgtagtcccagctactcgggaggctgaggcaggagaatggcgtgaacccaggagacagagcttgcagtgagccgagatcatgccactgtactccagcctgggtgacagagcaagactctgtctcaaaaaaaaaaaaaaaaaaaaaaattactgtgaccagattggactcagcttgctgctggcatttggttcccaccataacctcatatgtcatgtgtttgcttatatgtacttttgtgttattgttggtgtatcttcaggataagttccaaaatgtaatattgctgggttaaaggattaatgcacatgtagttttattagatgttaccaaatttccctccagtggggattataccatttttcattcctgcctgaaatatatgagagaagcaccattttaaagttttcacaatgtctctgaactaaaatgtggtagagatgcacatgtgtatatctagatctagattgatatattgatatacatgtatttttgtagaaggggcacagaggaggcctcttgactatccctattatgtttattgcttttaacgttttttctcacgccgggtttaaaacatggtttagcattattgaacattctaaaaatgagacataatatgaaggaaatttactctgtgcatcttttgaattataatcaccatctgaggcttttgtgagctccagtttgtcctggaatttagaacattcaactagtccagctattgtttcagtggaatcttgctggcctgaacagttttccttctggttacttttcagggactaaaaatgatgaagagttttgtgatagcaggtgcagtttgagtactacagtaaacattcagtttcagaacttcttctcttacctgctaaaaccaaagagaaccttttttttatttttacttctgattgttgaacagtcttaaggcagcattaggaagactggcgatttgtgtggagaaatgatggcttgttgttgtctatgcatactttgtgtgtccagtgcttacctggaattttgtctttcccaacagcaacaatggtgtggttggtgaatatggcagaaggagacccggaagctcaaaggagagtatccaaaaattccaagtataatgcagaaagtaggtaacttttattagataatatcttgatttttcagggtcactgttataagctaacagtatagcaatgtttttatcgtctttctttggtcatagactcctttgagaatctcttgagaactatgataatgcccagtaaatacacagataagtatttaaggagttcagatactcaaaacccaacaatacagtcaaagcatcctaggttaagacacctcccattaaatacagaataccagcatggaaaggttcaggctgaggttatgattttgtttttgttttttgtttgttttttataagtcatgattttaaaaagaaaaaataaactctctccaaacatgtaaaagtaagaatctcctaaaagaaacaaaaaagaaacagacaataaaggaaaaataagtaaacaaaaaaagcaaaatataaacaacataaaaatgagaacctcttgtctaacatggccagaataactgaaatatgatttgagatgtgctgatgtgtatactgagaagatcaaatattctaggtggatatgactttttagaagaggataagaatgacttaggatgagctgggtgcagtgatgtgtgcctgtagtcccagctacatggccaaggcaagaggatcacttgagctaaggagttccggattaccctgggcaacttataccttacctcaaaaataataataataatgaataataataatgacttaggataagagagtgaaaggccctctaaggatactacagaacatattaaggagaacacaagttagaagttgttattagatggagttgagggggagctttcattcagttttctggaatggaggctaccttcccacacacactaaaaaaaaaaagaaagggttgaggaataacagcacaatataaatagtctaaaaaaagggctaacttttatgaggaatctgaaaaacaacaggcacagtaaatattggtgaggaaaaaaaggccttaattgagttgctgtttgtcaggaaagggagagtttatgttttataaagccaggaaatctacagagttagcatttaggcaactgcaaggaagatactttcaaccaggaattcctatttggaactcagagatgtgagtctttattatacagtaagcaaggcagcagaacaaggtcatgttagactctcacgggatccttagggtgtgactttgctagccagaaacctctgtggctggtggcaccttttcctgagatttgctcaggcccactgggctcattccacctactcagcctagctggctatgcttggctttctctaccagctggaccccatgcctgccaaaggcaagccaggcatggagcagcgaggagtgcatgagcaagtgagtgcagggtccagccactgcacacagccaggcatgctggctgcagcagggcaggcagcctcaggtactagctccctgctgcagctagaccaggcattacctaagcagctttgactacaggccactaccactagtaaacctgatagaaaagtaagaaatatactggaaagaattgccacaagcctggctcttgtgttaaccttgtgttaacctggggaacacaggggcacccagaagcttggagatgccaggaactgcagaaccccaaagaggggggtcatagccctggcttagggaactcctgagtctggactccccgaagggccacatctcttcactcctctcttctctccttctcgccacctgcaacgtggcaagtggggggcacgtttcagccctgtttgtcttacggttctttcaatcctgccattcaatgggtcccaagttcttgtcctgcatccaggaagaatgaagtacgtggacagctggagggagagcaagatgaaaaggtgctttattgagcaacagtacagctctcaggagaccctatctgcaggcaggtcgtcccattgtctctgcagctctcagtggagaggagacctggagtgggtagctcctgtctgcaggcaggtcatcctgatgtctgtaatcctcagtggagaggagacccggaatgggtatctcctatccacaagcaggtcatcccatcatctctgcagccctcagtggagaggagacccggagtgggtagcttctttctgcaggcaggttgtcccttcatctgcccaagtctgactgagtctggggtttttatgggcttcagaggggaggaagtacatgctgatgggtccatgggtggccatgagcaggcccagaaaatgcaccataagttctcactgtggtctgtggaactgggagcttggcctccaggcttcaggctttccctgacttgaggtggtgcttcaccagggaacttcccctttccgcctaggagcctgtctgcctcctgctgccatcaacctgctgtctatagctcccatggcacccaggctgttcatgccaaagggtgcctgcaggcccacggtaagctgccttcagcccctcctcagtctccctcccatgcttgtcagcacccaaagtccagagggggccaaggtggcagggggctggcatgtcagtgctgccccaagcgcccgcacacccggccaggtcatgacagcacccagcctcagccacaactttgctctgaaatcggagcctgcagacgcaaggggcttcctggacccctgagagcacagggatgcccaggtctacagccacagctgggaagctgcagctgtgggagtgcgggacttctgccccaccaactcagaagggggcaggactcccgcctgttcctggctcctgccagctcacagagcatgctgccccagctgcacctcccctgctgcagctgccatctttgcagcagccactccagatgggccgctgctgccatcaagaccactagtaaacctgatagaaaagtaagaaatatactggaaagaattgccacaagcctggctcttgtgttaacctgtgttaagctaaagaaaatcaaatgattgtctgtgagcatgtaggtatatatgtatgtgagtgagtgatacaacagaatttcattcattttacagatgttgactgagcacctgactatgtgctaggccctggggatatagcactgaacaagatttcccctgcccttgtggagcttatagtctatttggagagatagatggtcaacaaattattacataaataattcatacagttgtgataggtactacaaagaagacgtataagttgctatgaaagtttataataggggaattttacgtatcctggaaagtcaaggggtgcttccctgaggaagtggtaataggggacggcccgctgaaggatggaggaagagctttccaagagagggacaacatgagcaagggctttgaaatgagaaggctggatgaactgcaggcttcctcagtgagaatgctgctggtattttggggggcacagttctttgtgggactttccctcatattgcaagatatttaacatccctggcccctcacccactaaatgccaataatggctttaaggctttgcaataatcaaaaactcctccatcctagttatttccaaacactccccggaagggaggtgctatccctagttgaaaaatcactgtgttaacggaactagaagttacattggaacaaaagggcatagggctccaagagggatatctgtgtaaggaaaaaacaaacaaaagaactgagagattacctgatgtggttgagctctgtcagagcatttcaggataaattagtcatagataataatataaaattcatcagtggaaaaaaatgaggcagttttccaaagaaaacaaaaacttgctcaaaaaagcaaatgtaattatagtatattctggctatagcaaagtagtttagttgtgaatattatttgcatagtgagaatataaagctgaatttaatataaggttatggcactgggaagacaggaagagttacatttgcgtgcactaaaggatgagacctaatgctttatcttctctataggaggtgaataagtacctcaaattaaaacatcaagttatggcacaatgagcatgctacttataattaattatggaggtaaataccaaaagggatggctaaaagagtttaaggtaggaatgagtatcagaagtgaggagggagggggtagaaaagggactgctgttttcatttataaatcttattcttatattatttcataaactccaaaccagagaagattcaggtttttggagatctggataataaaaagaatacaaaactatcaatacaaaattgtgagggctctcccagaggaagccatgcaaggaagggccctgaagcttacaagctttacttattcatggcaaatctacttctgctctgaacatgtattacttttataaaaaatgaaggaagaataaaagtactttgaacttcacttatatattttaattatttttaatgtatggaagttttttaagactatcatgctcaccattttcaatgagattgatagtcattataatgaaatgactggcccataaagacattcactccccgctcctttcccaatccaccctccagaatgaagccacttttataattttgtcaccaaatccagggatgagtgccaacagttaggaagctttcagttgcaaaagataaaaagcccaactcagttgccttaaacaaagaagaaatttattctttcacgtgacaggaaggcctgaggtgtaggcatttgaaatttgtagggttggttaatttggtggctcagggatgttttcaagtagcccaacttcctactctaccatcactagtttataggcttggtcttcagcccactgctcttcgtggtcatgacagctgtagttctaggcatcatgtctagataaggcaacattcaggggtagaaggggactgtttattttttcctttagtctctcttaaagagtgagaaaaattttcccaggaatcccggtggactttgcttcaccactcataggttcataccaagttacaaccccacaaccttagagcttttgttaggaagaggcttggtgggattaccgtgcttggcttggcttggtcaggattcaccaccagagtcatgtgggagggggtgggaacccaaacaattcaggattctgccctcaggaaataaaggagaaaatagctgttggataaactaccagcaggcactgctacagcccatgctttgtggtttaagggccagctagttacaatgacagctagttactgtttccatgtaattttcttaaaggtattaaatttttctaaatattagagctgtaacttccactttctcttgaaggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaagtatgtgcatttctctatgttgcaaagtcatggattcctttaggtagctacattatcaacctttttgagaataaaatgaattgagagtgttacagtctaattctatatcacatgtaacttttatttggatatatcagtaatagtgctttttttttttttttttttttttttttttttttttttttttgagacagagtctcgctctgtcgccaggttggagtgcaatggtgcgatcttggctcactgcaagctccacctcccgggttcaagtgattctcctgcctcagcctcccaagtagctgggactacaggcgtgcgccaccacgcctggataatttttgtatttttagtagagatggggtttcaccatcttgggcaggctggtcttgaactcctgacatcatgatctgcctgccttagcctcccaaagtgctgggattacaggcgtgagccactgtacctggcctcccttcagactttttaagttggcattttacagcctgaccttttggcatttattttataaagtaaaagatttgtttttttaattgttccagtaagccttcatggccgtaatacatttgtctacaaaaattttattaatatgtctcactctgctgtagagagatctgtggatttgcatgatacaaccttgtacattattattccttttgttgacaagtgctatattttattttaaagaaaatcaaagggatttaggatattggcagaaatgcaagtatttcttcagtgtctaagatgtgttgccacttgatggatttaagttaacacttagggcttcttaggaacattatcagccactaaagccctttggttagggctcagtcatctcttcagttagtcttagagatgtggttcattgaataagactttagcatattttccaaccaagttatttttggttgtcttgtttttgcaagagtgaaacttgattaaaacattacaacaagaatattaagtagttttaaggaaacaaacacctaggttccttagcatctttaatcattagtcactaattattatgaccttgacatatccatcagtttgaggagaacactttttacaccttgtcctcagttttttaactgagtcagaactttcactgggcatgttcatgactttactgcttggctgagttttccagatatcaaagcccagctgcagcctgtgactttcacactcctggaaaagtagacgtatctgcctgctcttacagcaggctttagcttgcctttgctgggactttgttctgccctcagttaccacagtaattaggttgcctcttctactttcctcttttctcacaggcaccaggagccagaggaaataacataatagttgttgaccagagcagcagcataattctttcatgactgccttttctaatttgacgattccctctcctgagagggctctttgtgtcctcctcctcttcgtctccaacttttaaaaaaaaaaaagtgaaactatcaagtattgctcctgctaacttcagatcagtattttctttctctgaagccaatgcaaagtaataacggacgtgcttcatcatcttagcattcagcacacgtgtcaccatctctgatggtgtgagcatgttaaaccagacttgtgggtacttaccaaaaggttcagttgacactataggtcagttgctaaaaggcacaaatgtcttctaaagcaatctgttaaaagtcaacatttaacatttaattagaaaactgatcaaaggatctgaatgtttagttctcccaagaaaatgtaaaaatgatctgtaaacacataaaaagatactcagcatcattagccatcaaggaaatgcaaatcaaaaccacttcatactcactagattggctataataaaaaagatagacaataacaggtgttggtgaggatgcgaagaaactggaatcctcatacactgctggtgggaatgtaaaatagtatagtgattttggaaaacagttcggtagttctttgaaagattaaatatgacccggtaattctactcctaggtatatactcaagagaattttaaaacatatgtcaacacaaagacacatatacaatggtcatagtaatattgttcataacaggtaaaaacagaaacaacccacatgtctattaactgataagtggataataaatgtggtatattcatacaatggaatattacttggttataaaaagaaacaatctatcattagtacacttaggatgagcttgttactggcatgttggctgtgggaagtatatcttgaaattcactaaaagaccaactattgctgggcgcagtggctcaagcacctgtaatcccagcactttggaaggccaaggcaggcggaccacctgagatcaggagttcgagaccagcccaaccaacatggagaaaccccacctctactaaaaatacaaaattagcccattgtggtggcacatgcctgtagtcccagctactcaggaggctgaggcaggagaatcacttgaacctgggaggtggaggttgcagtgagctgagatcataccattgcactccagcctgggcaacaagagcgaaactccatctcaaaaaaaaaaaaaaaaagaccaactaccttcacaataaataaaaatgtcttacatttctaattaaaatttttgttcagttttattattcagctttaaaaaggaagggaattctgacatgttacaacatgaataaatcttgagtactttgtgctaagtgaaataagctagttacaaaaagaaaaatactgtatgattccacttacatcagagtagtcagaaagtagactggtggttgccaggggttaaggggaggggaaatgaagggtcgtttaatgggtgtagagtttcagttttacaagatgaaaagagttctgtggatggacgatggtaatggtagcacaatgatacgattatacctagtgtctttgaacggtgaacttaaaaagggttaagatgttaaacttgatgggtatcttaccacagttaaatttttattatttttttattttttgagacaatttcgctcgttgcctagggtggagtgcagtgctgggatctcagctcactgcaactctgcctcccaggttcaagcgatactcctgcctcagcctcccgagtagctgggactacaggcacacatcaccatacccggctaatttttatatttttagtagagacaaggtttcaccatgttggccaggctggtcttgaactcctgacctcaagtgatctgcccacctcagcctcccagagtgctgggattacaggtgtgagccactgtgcccggccaaaaaaattttttttaaataccgttaagaagtggaaaataaggccaggtgtggtggctcacacctgtaatcccagcactttgggagaccaaggttggtggatcacctgaggtttggagtttgagaccagcctggccaacatggtaaaacctcatatctactaaaaatacaaaattagccgggcgtggtggcgcatgtctgtaatcccagctattcgagaggctgcggcaggataattgcttgaaatcgggaggtggaggtttcagtgagccgagatcacttaaaaaaaaaaaggaaaataagctaccagctgagagaaaatatatgcaaatcatattgaagtcctgttaaaggacttgtatttaggatatataaaggatgcttacaacttaatacgaagacgatagcccaaatttaagatagggaaatgctttgactagacattctaccaaaagagatatataatggctaaaaagcacatgaaaagatgctcaacatcattaatcagagtggctagaatgaaaaaggctaacaataccaagagctggtgaggatgtgaaaaaactggaactctcaattgttgctggtggaaattcagactggtacagccagtgtggaatgtgatttggcagtttattaaaaagctaaaaacctaaacttacatagcccagcaattgcacccccaggagtctacccaatggaaatgaaaacagtccgtccccacagagacatggacataaatgttcatagcagcattattcagaatagccccaaattgaaaacaatccagatgtccatcaactggtaaatggataagcaaaccatataatggaaaaccattcagcttccaataacttccaagaaactgtagacacatgcagtatcatggttaaacctcaaaaacattatattaagtaaaataggcgaggcatgtattgtatgagtcatatgaaatgtctagaaaaggcaaatttattgagatagaaagcagatcactggttgcttaaggcctagggtaggagtggggattaactgtaaacgggtacaaggtacctgactggggcaatggacatgtggattgtgatgatagttaaattgtacagctctctctatatatagttgtacagctctattaattttccacaatcattgaatcatgtcttccagttttatgaggtaaatcatagtccaatgaagcttttttaaaaataagatgataggccatgcgtggtggctcacgtctgtaatcccagcactttgggaggccaaggtgggtggatcatgaggtcaggagttcgagaccagcctgaccaacatggtgaaaccctgtctccatcaaaaataaaaaaattagccaggcatggtggcatgcgcctgtaatcccacctactcaggaggctgagacaggaaagtcgcttgaacctgggcggcagagtctgcagtgagccgagatcatgctgctgtactccagcctgggccacagagcaaaactccatctcaaaaaaaaaaaaaatattaattaatatgataaaatgatgcctatctcagaattcttgtaaggatttcttagtacaagtgctgggtataaactatatattcaatagatgacgattattacttattattgttattgataaataacagcagcatctacagttaagactccagagtcagtcacatagaatctggaactcctattgtagaaaaccaaaaaagaaagaaaacacagctgaagcctaattttgtatatcatttactgacttctctcattcattgtggggttgagtagggcagtgatatttttgaattgtgaaatcatagcaaagagtgaccaactttttaatatttgtaacctttcctttttagggggagtaaaacttggattgggagatttcattttctacagtgttctggttggtaaagcctcagcaacagccagtggagactggaacacaaccatagcctgtttcgtagccatattaattgtaagtatacactaataagaatgtgtcagagctcttaatgtcaaaactttgattacacagtccctttaaggcagttctgttttaaccccaggtgggttaaatattccagctatctgaggagctttttgataattggacctcaccttagtagttctctaccctggccacacattagaatcacttgggagcttttaaaactgtaagctctgccctgagatattcttactcaatttaattgtgtagtttttaaaattccccaggaaattctggtatttctgtttaggaaccgctgcctcaagcctagcagcacagatatgtaggaaattagctctgtaaggttggtcttacagggataaacagatccttccttagtccctggacttaatcactgagagtttggtggtggttttgcatttaatgacacaacctgtagcatgcagtgttacttaagacagcaagcatctagtgagaggagctggtgccatgcatgaccccacatagatcttgctgatagtgctacagcatgaaccctgaagctttcaaaactatgatttttttttttttttttttttgagacggagtctctgtcacccaggctggagtggtgcaatctcggctcattgcaacctctgcctcccagatttaagtgattctctgcctcagcctcccgagtagctgggattacaggtgcctgccaccacgcccggctaatttttgtatttttagtagaaacagggtttcaccatgttggccaggctcctcttgaactcctgacctcaagtgatgtgcctgcctcggcctcccaaagtgctgggattacaggcgtgagccaccgcacctggcttttttttttttttttttttttggagacagagtcttgctctgtcgcccaaactagagtgcagtgacattagctcactgcaacttctgcctcctaggttcaagcgatcctcctgtctcagcctcccaagtagctggaattacatgtgtgcaccaccatgcctggctaatttttgtatttttagtggagatgaggttttgccacattgcccaggctggtctcaaacttctgacctcaactgatctgcctgcctcagccgcataaagtgctgggattacaggcatgagccactgtgcccaacctgaaaactatgatttaagtaaacaacccataaaatatttcttgctatttttactaaagatgtgttatcttggccgggtgaagactttctagtgtttccgtaactagggtaaaaaatgaactctattatatggcttgtacatgtgtttacaagaaagcagtgtactcctcataaataaacttttagtttattttattttttaaacactgcagcctcatcatgcttcacggaggagcctgtgcgggaagaatgctcccacacagcataaagaatgctcccgcacagcatagagaatgcccccgcacagcatagagaagcccccgcacagcatagagaatgcccccgcacagcatagagaagcccccgcacagcatagagaatgctcttcacctctgggtttttaaccagccaaactaaaatcacagaggccaacacatcatttaagatagaaatttctgtatcttttaatttttttcaaagtagttttacttattttcagattctatttctttactagaattaagggataaaataacaatgtgtgcataatgaaccctatgaaacaaacaaaagctaggtttttttcatagctcttcttccagattgaatgaacgtctgttctaaaatttaaccccaaaaggaaaatattcagttaactatgttaaaaaccaagacttgtgattgagttttgcctgaaaatgctttcataattatgtgtgaatgtgtgtctttcccatcttctccacagggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgctacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttcctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctca

SEQ ID NO: 11745 - DNA, 36180 bp, Human
gtgccctgtgggtgcgaaccacctgggggtcctgtttgtataaaatacagattctacttcagtaggtctgggatggggtctgaaagtctgcatttgtagtcagctcccaggtgatgtgggtgctgatgatccctggatcacactttcagtagctggagaatattttttccaaataaaagggtgattttgtctcgcctccacttaaaacactccactgacttcctaggaatcccacaccatcgctgggtcccacatccctggcaggattcagctcccatcagaccttctagccccttgctctccactctcccactctctctttcccccttgtttatgggtttgttaatttatttatgatgaaatgaaatgaagctaccatccaccccagtactggaacattatcaataacctgtgtgtggccaggcgtggtggctcatgcctgtaatcacgccttgggaagccgaggtgggtggatcatgtgaggtcaggtgttcgagaccagcctggccaacatggtgaaaccccgtctctactacaaatccaaaacttagcagggcacggtgccacgcgcctgtaatcccagctactcgggacgctgaggccgagaactgcttaaaatccaggaggtggaggttgcagtgagccgagatttcgccactgcactccagcctgggcgacagagcaagagtccatctcaaaaaaacaaaaacaaaaacaaaaaaacaaaaaacaaaaattagccaggcgtggttgtgggcgcctataatcccagctactcgggaggctgagacaggaaaatcgcttgaaacgctgggggtgcgggggggcggtggggaggaggcgggccagaggggcagaggttgcagtgagcccagatcgcgccacttcactgcagcctccgcgaaagagcgaaactccgtctcagtaaataaataaataaataaataaataaataaataaataaaaaacctgtacccgcgtgttatttccctccgtccttacctcctcccggctccttccctttcacctgagataaccactcttctcgtatctatgctcatctttcccttgctttacattttttccaccgatgcatgtgtctaaacatacatacttttggttttgcttttacacattctaaaagttgcaccattgtatgcagttttccgcaacttagtttttttcactcaacattgtttctgagacattgtttctgttgttgtctggctgaagttcattccgtttcactgctgtctaacgtttcatggtgtgaatattccggtttatttgcccactcgcccgtggaggggcatttgagggtgtttccaatgttcctgttattcggaatagcgctggtgtgaacattctgcacaggtctctggctgcgcctgggcgggtttcttaaaggtgaatgcccaggaggggactgtctgtgttctccctccctccgagctccagccttcctcgcctcctttcactcccagctccctggagtctctcacgtagaatgtcctctccacccccacccacccctgatgaactcctgcaggttctgcaggccacggctggcccccctcgaaagttccttaactatacaattatggtgtgtgtttctgcgacgagcgtccgtctatccggtggaaggcacgccgctcgaggcttgcgatgctcccggggtccccgcttctagcttgggcctggcgcacagcagcgcccagactgcagggggacgcttgaaagttgctggaggagccggggggaaggcagcgcccagcgaggcggctggagcgcgcgcccacaggtgggtccggtcgggcgccgcggggccgtagttttcgggtcggcgggcgaggacgccgggtccagaattccaggaaatgcgcgatccaggccggcgggcggggcgggggctccggcgagagggcgggccccgggaacggcggcgggcggggcgggaggcggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtgagcgcgcgcgggggctccggggacgggggtccggcgcctgggcggcccgaggggcttagcggggcccagcccggggcgtccaaaccctgggaacgaacgggggctcctgcaggcgagttcttccttcggcttaggccgtggcttgcttgcgggctaatcagggacaatggggcagagaaggtccagaacccggaggcctccagagtctgcttctgcccctgacttgacccctctgggtctcagtttcgctgtctgtcaagtgggcatcctagcaccgctgagcgctgtgtgggcctgggcagggacttgaggtctctgaagctcagctgtatgatcaggcccgatgtctacgccggataggcacctagtgctgtgccccgcgcctactgagtgctcagtgaatggaagcagctttgtacgccagcgttatggtggtgagcgccaaggagctcaggtttgtggatgcgccccggggaagaaccgtgagccctgccagaaaggggagggaggggagcagagcaccccccttcccccgcgcgggaagaacaggagctaggtaggccctgggtttggggccctagcagggttcactcgaggccaagccatggccactggccccaggggagaatccccttgtttctccgcccaccagctgtggcgtcttgggactgttggggtcagggagggtctggacccccttggcctgtctcagagtccgagaggaggggcccaggagtctgccaagcagggtgagtcagccagtagggtgtgagagtggttggggaaggagtcagctgcagtcagcctcaacttacccttctaagaaataggtgtgagtggcccaggaggttggctcacgcctgtaatcccagcactttgtgaggctgaggcgggaggatcatttgagtccaggagtttgagactagcctggacaacaaaactagaccccgtctctccaaaaaataaaaaaagttaggggaagtgtgtgtggtggtgcactcccgtagtcccagctactcaggaggctgaggcgggaggatcgcttgagcccaggaggttgaggctgcagtgaggtgtgatggtgccactgcacttcagcctgggagacagagcgagaccctgtctcaaaaaaaagagaagaaaaagaaaagaaaagaaataggtgtgaatgatgatgacagctatcacaaaagtgccggtgagaatccagtgagtgtgcatgtgtcagtgagggagacaggctgtggagagcccacctaccttctgaggagggtgaggcctggcccccactactgatgcccccagcccagggaaaatgctcagctactccccgtcagaagctggaagcactgaggtgctgtacaagccctcctacccccacccctgcctccttcacgtcttactggagctggggcccatgattggcgcctcccctttgcagtctttttattaaatgctctgggctccctctgcccttgggctggggacccactgtaccctgatgtgaatcctatggcagtagcaaagctctttgattggcggggtgcagtggctcacgcctgtaatcccagcactttgggaggcaaaggtgggtggatcatgaggccaggagttcgagaccagcctggccaacatggcaaaaccccatttctactaaaaatacaaaaaattagctgggcatggtggcgggcgcctgtagtcccagctacgcagaaggctgaggcaggagaatggcataaacccgggaggtggagcttgcagtgagccgagatctcgccattgcactccagcctgggtgacagagtgagactctgtctcaaaaaaaaaaaaaaaaaaaaaaaggctccttgattgcgaacatgttgggagttatggagagaacagcagggcccacttctagagcacttgttgcagacacccattggatccttgcagttcttctgtaacagcccatcaagggaggggctcatattattatccccattttttggccttgctcagtcctcccatctgattcaagctggcagatcattttccctattgggacctcagtgtccacacctggaggatggaacatcagctgcttatgtgggtgtcccgtgtcctgagtcccaaggccacaaggtgatgcttgagagtgaaggtagaatgttacctgccatgtgtttgaggcgtgacaaatcttgtatgattgtgaggaggaacttgtgtgagctggcaggagaagtgggaaggagtgtgaatctcagagccactgtgaccagagccagctccctgccctcttgtgggagggacagatgacagttataattattagcattactagctgcagctaatggagtgttgatgtttctgtgccaggcaccgttctaaacacattatctgcattttttatttaatccaggcacagagaggttaactaggcccaagatcacacagctaggaaatgtccaatctggggtttgagtccaagggaggctggcttcgaaatcccatgcctctaaccatctttcctaaactacctctgcagaagcctttggggatagaggtgccagtgccccaggtgcaaacctcctgagacaggagcctttgctgtgtccttcagcttctcatacctgccaccagctgaggcctgggacctggtcagctagaagaaagcagagcagggcagcgcttttcaaactgcactcaagtggcctgacttttaatgttcacactgtgattctgtgtgggtcgggttggggcctgcgatgctgcactgctgaccagctcccaggaaatgctaatgtcaacgatccaggaacacactttgcttagcaaggccctaggcagctgccttctgttgtgcgggacccctattgactccaatggatatagcaccaggttcaagaggctaccttctttggaagaggtagcaaacaagatacggggttttactgggggcttagacacagggaagagagtccagtggcggcagactgagcagaagaaccgcaaccacttgcaaatcatgcagtttatgtagcattttcatttaacaccttctcccaaccatctccacctagtaaccttcatttaacccaaaacaaagggcctcggtccctatacccctgtatggtcagtgtcccgtgggaatggggtggggctcagatgttcctcatagataacgactggatctccaggttggccactcttggattccttcgctcagaactctgaacacccattcaagtgtgcctgccatgcagggtcatcgtcaggggatgcccaagtcaagtttgccctgtcgggtgtgcctcccatacccccacctggtttgacttagcacctgctgggcactggaagaagtggaaaggggggttgcaggggtggcccttatcagcctatgttcacaggtggcaccaggcactcaggcattctgcatcctggaggccagtgctgatcacatgcctgttacaataatcataacaatagctgtccttgaagtagtcctgggtaccaggtgccttcagtgactttttcttttttgccagaatctcactctgtcgcccaagctggagtgcagtggcaagattttgggtccctgcaacctctgcctcctgggttcatgcgatcctcctgcctcagcctcccaagtagctgggactacaggcgtgtgccgcagtctcactctgttgcccaggctggagtgcagtggtgtgatcctggctcactacaacctccacctcccgagttcaagccattcttctgcctcagcctccggagtagctgggattacaggcgtccaccaccacgcccggctaatttttgtatttttagtagagacagggtttcaccacgttagccagctggtctcgaactcctgatctcaggtgatcctcccaccttggcttcccaaagcgctgggattacaggtgtgagccactgtgcccggctagtaacttttatctcacggaatcctctggacgacttgacaaggcatgggtcttcatccccatttacagatgaagaaactgaagcttagggagtggagggacttgccagggctacacaaaatctgagagccttgaagctgtagactggcaagtgaacaggtacaggctgggacagcagtttctttctttttttctttttttagacagagtttcgctcttgttgcccaggctggagtgcaatggcacgacctcggctcactgcaaccttcgcctcccaggttcaagtgattcttctgcctcagcctcccaagtagctggaattacaggcatgcaccaccatgcccggctaattttttgtatttttagtagagacggggtttctccttgttggccaggctggtctcgaactcccgacttcaggtgatccgcccacctcagcctcccaaagtgccgggattacaggcatgagccaccgcacccggccaagggacagcagtttctaaactgtccctctctgatgcagaggggaattggggctaaatcagcaatgtgccttttctgtctcatatttgaatgtctactctgcacgaggcgctgtcctgctttgcatacagtgactcatttaatgtttatgtcagccctctgaggaaggtcctgtcctattattaacttcacttattatgaggaaactgagactcagagaggggagggaacttgccaaagtcacacagctggcaagcagcagagctagacttgaacccagatctgcctgcactcaagtagaagctgttcattgctttgctcatttgccaattccactttatgcaaaaaagagggggcagtgtggggggaagagttagaatcagggtggcagggtgggccagtgcattagccctgggcttcagatgtactggggttgaattcctgcctgccgcttagcagctagggtacctcaggtagacaactcctgaaactcagcttccccctctgtaaaatggggtgacaaaaccaagatcttggggttcttggggaaactgacatgctgattggtttttgtacagtgcctggctggtaacagcaggccctcaggggtgcgtttccttcctggggactggagtgggggttgcagtagactctgggaggcctctccagctgcagaatctccctcctccctcctcctttttgtcttcctgacacaaaacccaccagctgcacttctttgggcttgcagtggctttcagttaccagagccacctgttaaaacaaaaatgtgcctaggaagagcctgccttacccattttgactcacatggcagttggtggtggaggggaacaaaggagactgagtttcatcgaagccttttgcttcggaggaggaagggaggatcagagagaggaagtggtctgtgttcacacagggaggcaggggaggccaggcagcttcccaatcctgcattcaacctcagggtgggcttgacctgggtggctgggggccctgtgatccaggagagacttgtccacctgctcaggtgtcttgaaggggtccctgtggtaccccctggggcggggcaaggtagtaggaccatggtctggctggggaggtggagaggagcaggctgtgggcgcagagtgaggttggaatctgtatttacccaaggtgttgggggtaggcttgccctcagcccttaatgttctcaggcccctgagcagttgtgggggataacctctgcactcctagtgaccagggagctagaacagcaaggaatttgaacttggacaccagctggggtcaggctctctgggtctgagtcctgatttcccactttccagctagaggagcttgaatgagtcatttaacttcacggtgcctcagtttcccctctctaaaatgagaattatacccatacccacctctcaaacaccaagtgcaggcctggctcagagcaggtgctgcagcaatagctgccattggtcagcatcatcatcatggttggtaatggtcctactttgacttttgagacagagtctcactctgtcgcccaggctggagtgcagtggtgcaatctcggctcactacaacctctgcctcccgggttcaagtgattcttctgcctcagtctcccaagtagttgggattacaggtgtgcgccaccatgcctggctaatttttgtgtttttagtagagacagggtttcaccatgttggccataacaatggctgtccttgaagtagtcctgggtaccaggtgccttcagtgactttttttttttttttttttttgagctggagtcttcctctgtcacccaagctggagtgcagtggcacgattttggctcactgcaacctctgcctcctgggttcatgcgatcctcctgcctcagcctcccaagtagctgggacttgggatacacttgcccccgctggtcctcccttccacctctgtgaagaggaggtctcaaactcctggcctcaagtgatccacccacctcagcctcccaaagtgctgggatttcaagagtgagccaccgcacctggcccctgtttagatgttagcatcagtgacccagcaccttgctatgtggcatgcagggagcgtgctgctagacctccgggtttagagtcaaatagcttcctggctgtggtatgcattagactttctaactcaaggtcctcccactctctgagcctcagtcttgttgcctttaaaacgagtttaagtgtgctgagtccctatgctgtggctccacaggaatttccccaggtggaagacacatcttgccttctgtgaaacctctcagcagcagagctgtcaggccccgtcagcaggagacactgtggggactgctcagtcccttccactgtgtacctcggagctggcggagcctagatgaggctgagcatagagggcttcctggaggaagtggagctgaaacagtttctcagcccagggctgctctgtctcctggcctcacactaaaagtcagttgagaggccatagtggcataagtcactgaccctggcactgcccagctcatcaccaaaagcagggctagggagggaggggacattcgattggcagtgggcacctgtggctcatctgggttctggccacggtgctcaggttctgtgagctgaccaggcagccctggctcctctgcccccgtgtgggttctgccaggtcccatgggggcaggtcagccccttccttgttgcagggagagcacccagcattgctgacatgggacagggaaacgaggaaataacggtgtggtcattgaacacagagagcactaggtgctgtgcgaggtgctgaggacacgacatgatgacacagacaaggtcccccctctcagcaaacggctcatgagggagacagacatgttacatacatgaacccaaaaagtcagacgaaaacaaaacagagcgatgtgtttgggaggcaaacccaactgccggagggcgagcagggcgtctacctccaaggtaaacccagtcagattagttgtccccaaggctcaccagggagaactaatctgactaggtttgccttggaggtagacggccctgctcgccctccagcagttgggaacgtggaaacatgagtcagatctgggagtatctgtcccaggagtccaagacctgggtcctcatggtagctctgccaccgacacactgagtgaccttgggtaagtgaacccaccgccctggacctctctggcacgcatctcttgagagcagggacttagtgcatttcccgagggcctccacggtgcctggcacatagtggggcttagtaaatatttgttggtaactgaggatgcttcctgttcacatcagcgctgggaggatttcctgctgttcagacaaatgctgggctggctgtgagtcagccttgcagagagcaaaggcagtgggaaggggcgtgagattcccctctggagaggtcaggaggccaggcactgtctcgacatgagtgccagggagggggtgtggcctgtgggcagggcttgggctgaggcagagggacttgagttccaccctagctctaccaccatcaattttgtgtaactctggacaggccactgaacttctccgggcttagcctggcaagtccatttccccatctgtaacatgggccgatatgtacattgcctagggattaaatgagataaagggtctgaaaacagtaggtagctgctttatcattattattatttctgtattattgatgtctgaggctaggcccacagaggcagtacagtagagtggttaggagctcaagaatcagactagggttcaaattctgactccatcactgactgttttggggtacttctttgaacctcagtttcttcatcagtaaaatgggagtgaagtctctaccttgctggttgtaaggatgaaataagataatgcatatagatggtctagcacatagtagatactcaaaagtttgaggccactgctgacccttttccctgaaaggagacaggagagcggggtcgccaccccattgtcattgtcatctggaataggctgacagacttcccatggtgtgttgcagttttctagaaaattcagtaggaggcctgcctgagcttgagccacctgtggaggtggcttcctgcctctgctccacacctgaaacgcgtctgggcctcttctcaggcagccgtgagaagggatgagtgctactggtcatggtgggcagctggctctgctttcccccttcccagaggcgctcctgcctcctgcccagctccctgaacccctagcttctgcaccccggcactgtctggcttctgccccgctgagcacccactgtctctgacgctgccttgagtacttcccgcatgttattcaaatcccaatcagatcttccctcccgcagtagctggtcttctgttctggcttcctgccatcctgtcctccacacagcagccgggaaaggtttttttaaaggggactctccgatttaacacacttgggtggaaaaccctttgcttcggcctctgcaatctccctgccccctctccactttgccctggcctcatttctcaccactaacctcactctgcactctggccaactccccgcctgcttcctgattcagacactaagcacacgcagctcccctgcctggagccattctccctctccttctttcttctccctggagaactccccctttaagtgatcttttcccaacacactttctaaattgcccccaccccagtgtgatttttctttatctcatagcacttggtctgcttcttatcacagtttgcaaggctgagttcagaaaggtgtgtttgctcattctgaggcaggagaggctaccttgtgctgctgtggtaacaaacagcccccaggtctgaggggtctgcagagacccaggttgacctcatactgcttgtccctccagggcctccagtgaggtttcggctccttggatcactcagggccccaggcagatgggaagattccactctgaacattgccaattgttgtgccagagtaaagcagagctgggaggtgggctcttgaattggcatttaaatacttttgccaggcagggtaaggcagctcacgcctgtaatcataacactttgggaggcctaggtgggtggatcacctgaggtcaggagttcaaaaccagcctggccaacatggtgaaaccctgtctctactaaaagtacaaaaattagccgggcatggtggtgggcgcctgtaatcccagctacttgggaggctgaggcacgagaatcccttgaacctgggaggcagaggctgcaatgagctgagatcttgccactgcactccagcctgggcaacagagccagactccatctcaaaaaaaaaaaaacaacaacaacaaataaataaatgaataaatactttagccagaagtagccatgcagacctccccccaccagtcccacccacaagcggacgtgactaccgcccccattcactgcctgatcctcctgttctcaggggctccaaggccaggcctggtttgaccttctgactttctgacttcctcctaccttcccagtaacctcatgcaactcctttcactcagcctcaatcatccccatgggtgtttaaacttgcccaagacatgcccctttgaaaaagcctgccattctcttgacccacatgcacgtcctgccccctccaaggctgctagttcctttaggggcaaaattgtgaaagagtagtctaaaccttcttcctcttcttacctccacttctttcttaccttattcccatgtggattctaccctcactcaggcctctagaacggttcctctacggcagtggttcccaatcttgactacgtgtttttttaaaaaaagtcctccacctgggcctgccaccaaggatttttctttaattgacctcagatggggttgaggccttgggaactggccagaacttcccgtgctcctaacttgcagccggggttaagaactactcctctgaagcccccagtgcctgcgcttttagcccgacggacaagtttctgcccttccatcctgtgacctccagcagggcctgaccatgtgagttttctgtggctgccgtgacaagttgccacaccctgcatggcttcaaccaacagaaacgtgtgccctggcagttctgggggccagaagtccaacatcaagatatcatcagagccacatgcccactgaaggctctcgggggaatccattccttgcctcttctggttgctggtggctctaggcattccttggcttgtggctgcatcattccagtctctgcctctgaggtcacgttgctgcttcctcttgtgtgtgtttctcttaaaactctctgcttctgtcttataaggatacatgtgattgcatctagggcccaaccagataatccaggataaactcttcctgtcaagacatttaataatcacactttgccatataaggtaatttttttttttttttgaggtggagttttgcactttcacccaggctggagtaaagtgatttaatctcggctcactggaatctctgcccccaggttcaagcaattctcctgcctcagcctcctgagtagctgggattataggtacctgccaccatgcccagctaacttttgtatttttagtagacatggggtttcaccatgttggccaggctggtctcgaactcctgacctcaggtgatccacccgccataagttaatattttttttttgagagggagtattgctctgttgcccaggctggagtgctagtggctcaatctcggctcactgcaacctccgcctcccaggttcaaatgattctcctacctcagtctcctgagtagctgggactacaggtgcatgccaccatgcctggctgatttttgtatttttaatagagaggggatttcaccatgttggccaggctggtgttgaactcctaacctcaagtgatccacccacctcagcctcccaaagtgttgggattacaggcatgaaccaccacgcccgacccatataaggtaatatttacaggttctggggattaggattagcatgtagacagctttgtgggggccaccattcagcccactatgctaaccctgtgaaccgttgctcgcttctccttgacatctgacggcctggccttctgcataccacacaccctcccacctctctggccacagttctgtaggctcagcctcctccgtaaggccattaagtgcttgtgctggtcaaagtttcatcctaggccttttccttacctcccttgatattttctccctaggtgagctccttcaagcccacagcttctgtgcttacccacactcctacctacattcccagcttgggcttctcaggccagctctagactcttgtatcccactgggttcttccacttacctttggatatctcaaaggcatctccagttggctgggcacgatggttcacacctgtaaccccagcactttgggaggccgaggtgggcagatcacttgaggtcaggagttcaagaccagcctggccaatatggtgaaaccccatctctactaaaaatacaaaaattagctgggcatggtggtgggtgcctgtagtcccaactactcgggaggctgaggcaggagaatcgcttgaacccgggaggtggaggtttccgtgagctgagctggagccactgcactccagcctgggcaacagagtgaaactccgtcttaaaaaaacaaaaaacaaaaggtgtctctagtgtaacataactaaaaccaaaccaatcatgcctccctcccccgcatcctccctcctggagggagctccaggacttggtcttctcttccagagttctctgtctcaaactgcgggaattgctccccacccaggcctaacctgaagtgtgagccttggcatctctttctatccacctgtttttcctctatgcacctcacaaccctggtccaagccaccgtcatctttcaaatggctgcagtagcctctaactggccttggaggagccatcctctttctctaaccagctgccaaccctgcaatggcctctgtgtgctttccagataaagcctgactcctcgtggcccgcacagccctgcctgggtggtcctatcctgcagcctctccagtaccatgaaccctcccttctctgaacctctatttaatccatttcatataccccgttttctcctgccatagggccttgcacatgctgttccttctgcctggaattttcttcctgcctccctccgcacccctgccttgtgttgtgggttcctcgctatcctctagcttttcgctcaggctcattgttggccctctagatgtattcacttctcttgtttgttaccctctgtcataggactgtgttcgtacttcccaaggagtcgtcttggtttgtgactgtacattttcccatgtgacatttgcttaatgcctctcccactctggggcctgtacaagccccaggaacaggacttggaccctcctgtttaactctacaatctagcatccagcaggcgcgcaggccttcgttgacttttattttattcttattttttatttttgagatgcagtttcgctcttgtcgcccaggctggagtgcagtggcgtaatctcggctcactgcagcctctgcctcccaggttcaggtgattctcctgtctcagcctcccaagtagctgggattacaggtgtgcgccaccacgcctggctaattttttgcatttttagtagagatggggtttcaccatgttggccaggctggtctcaaactcctggcctcaggtgatccacccacctcggcctcccaaagtggctggattacaggggtgagcccccatgcccagccttcattgacttttagttgacaactatttagcatttgctatgtgccaagaactccctgcctactaatgcagttaaccctcatgaagcctagaaggaaggactgccattctccccacttaacagatgaggatgccgaggcacaggaagtgaagtgactttctcagggtcaagcagggagtgagtggaggagccgagattccagctctaaccgcatgatgctctatacagtgtgactccggctctctggctgggccctctccatagccctgtgagggttaaggatagaaaacagaggctcagagagttgaggtcccttgcctgaggtcacacagctggttggccgttccctgggctataagcttcagtattcccaatgctgagcatattttgagaacccgagaaacagacgtttggctgggtgggaactgaactcattttgtcagggaattcaacaactaagttggccctgagactgggtgtgaagaccgctctgtcccctgccagctggatgacctcaggagagatctgatgactctgaggtcctgctgataggacctctggtgtctctgttccctgctggcctcccctgggcctgggttgggtttcctctgcaggaggcagctcatgtatgtgctcctagacgcccttgggccagcagctccttggctgttcctccctgagccagggcagccaactttcttatccagctctccatgctccccaccccagcatgagatgtcagctgagagttttctggatctcccctagctagggggaaagcttccatcatttggaacaggaacagcaggaacagcaaagtccctttccccaccatctcccactgcctgctgtgcttctcctaacagctcatggtaaacaccctgactgagcggcaggggctgtttcctttgggctatccatgtccacctacactgccctttttaatccttacaatttttcttggacacgggggcataatattccattgtttttcagttgaggaaactgaggctcagagaggtcaagtgtcttgtctgaggtcacacagcagaactgggagtcaagccagatgggctgcctccaaggatcctactcttaaactctagagtactagaaagatcttccgttgcctaatattgattcctgataggctatgcttgagtagcatctgcttttgaaaatggagcctgggtcggttgcggtggcacatacctgtaatcccagcactttgggaggctgaggtgggtggacacctgaggtcaggagttcgagactagcctgagcaacatggtgaaaccctgtctctactaaaaatacaaaaattaactgggtgtggtggcacctgcctatagtcccagctactccggaggctgaggcacaagaattgcttgaacccaggaggtggaggttgcagtgagaggagatcacgtcactgcactccagcctgggagacagagcgagactccatccgtctcaaaaaaaagaaaacgaaaatggatcctgaattttgaaatatgctgtgactcttccctagtttgggacatctgggtcaatcccttttgttaaagtagtttatttagttggctgagagcgggagctgcctacgtgacctggagcacaagctttggaattgggcttgggttagaattccgcctctgccactcaccagctgcgattaagaacaaagatactgggttgggctcctgcctctattacttgcaatctgtgtggccttggatgagatatttaacacctccgaacctcagtgtcctcaattgtgaaagagatcgagataacagctgaacccacatcccaggagcggattaaatgagatagtgcagtacagagtttaccgaagtatatggggtcagcagccagccagtaaaatggtggctaatggttatcatgattaatgttaacattaagctctgaaaggtccttcgtgaactcataggtatttgttctctctctccctttctctctctcttccccctgcccccttgcaggtagaactgcatgtccacctagacggatccatcaagcctgaaaccatcttatactatggcaggtaagtccatacagaagagccctctctccctgggatttgagtggggtccccagctccacccagaggcccctggggaattccagggtcactgttccttcctgtctccctgtgggaatcaagccagctccaggccagaagtgggactgtgaggacatggaggcctcggcactgagctgcagacccgcagaccaactcctgagctttctgggcctctgagtcttgtcctcctggtgtcaggtgagccaggcctgagcctgctctccccacccacccacatacgtgcatgaaggtagttcccagggctgaatccgtctttttttttttcttttgagatagagtcttgctctgtcgcccaggctggagtgcagtggcatgatctcggctcactgcaacctccacctcctgggttcaagtgattctcctgcctcagcctcctgagtagctgggattacaagcacatgccaccacatccagctaatttttgtatttttagcggagatggggtttcacatgttggccaggctggtctcgaactcctgacctcaagtgatccacccagcttggcctcccacagtgctgggattacaggcatgagccactgtgcctggctcctgtcttttgacttaactgagagcctatatatagcaggtgatgtgctcacatgagatgccagtacaatttcttgagcatctcctagagctgggctgggctttatcagctcattgaattcctccacgcttggaagaggaggatacgctctctgcattttactgaggagggaatgggctcagccaagacagttgtccacggtcacacaaattaatagcagatcaagagttgaacccaaggctgtctgacccctaaggctttactacatcatcagggtcataacctgctaggagtcacggaaaagtggctccccaactctgggcctaaatctctgcatcttccaagtgagaacacacttcctgcctcagctctcagagatgctagggggccagagggtccccctgttccccagcgaggaaggttcttcccttcctacccagacctcaagggctcacagcagctcctctcttaggaccagcttttaagggcagggactttaaaggccagtggatctggattcaaatttggacatattatctcctgtctgcgaacttggtctctatcaactgaggctaagaacaggccctccctagagagatgacctaggagctaggggctccttgtccacccagccctgcccccgcagacctgtgttcctcggatgtttgcacaacactcattttgtttggagctgaaagaactcagcctctctgtcacagtcttgaaattcagctcgggacccaaatttgaacatttctgctccataagccagaatcctgttattcagaggcctgccctcatggagagaatgagggatcccggggggttgcccccaactctcgggagcatctccaccaactccctgagagatttctggtaagtccactattctccatcttttcacacttccagggaccttcttctgccccaggaagctgccattgatttaattcctatttaactgcaaggcataagcacagtagcacctcctgtgtgccaaacactcctttaagtgcgttacccgggttaagttattgaagcctcacaacaatttgtaagataggaactctattgccgtcatttacagatgaggagactgagccgtggtaggtggagtaaggtgcccagtaagcacagggcggaggtttgaacccagatagtctgcccccgagtccatggccctggccattaccccctgtcagttagaggttttggtaagtgatgcccgtaaaatgcttagttcagggcctagcacacattaatgtgctccataaatgtcacttaatgataatattcttattaattggagcttatatctctaagtggggtgaaacctcttggcttatctctgcctggcctttgcccatgtcaagccgccaacttgccacaaggcccctaatgaggtcgttcagtggggcaccaagatgagatcgaacccaggcactcattaaggggtcacggagggctcatcagctgcagccaggggctgggagcgccgggtggggctaagagaaaggggaaaggagccgccgggaggggcactggtctgatcgtccattcctcacaccacctctgggccttggagatggcgtgcggcaggtgccagctggagcttggcctgaagtcagcaggcaggggactggggagtttgtcacactcagatatgggtgtctgtaaatgcacacaaatatgggctaagaatggaaggaggaggggagcccctggcctgagccctgctaggcccaattcagtggccctttttccagctctgggactcaggcctgcctcattaactgtcctcacccatttctccttcctccagttcccaggattctggccttttcaggggcctctccaacctctttctcagtcttgtttataaccctgtcaactatttctacagagattctgaaactggctgctctttcctccgatcactgccctggtctgggccaccactgcccctccctggtgctgtggcctcctgattggtctcagccatctactctggccttcctctctacgggccctgcagtgctgtagttggagcaagagccttaacccatggtcttcccagctcattccccagcttccccatctcactcagagtcaaagccaaagtccacacatgggccttaaagttctgcaaagcctgcattgcctctctgacctctctaaggctccttgcttagtccacactggatgtttttcaaacatgccagacctaggaaacagagagtctgggttacttgcccaaggtcacacagcctttaagtcacagagctgggattcaaacccagaccactgggcttcagagtctgctctttctcatgacacacaaagtttcatttcttcctctgtgcacccctacatggaaaatattatgttttactgacaagggcaccaagggccttagaggggagcgctcctgcctgggatgatgtggtaaataggggtgggagatggacttgacctgcaacccctgcgctcatcctccctccctccctgggctcctgatggtgggcttcttgtgactgtgttgcccaccaaggccggaagaggaccagacagtgccccagcacagcagctgtggctgaccagggagtagggatcatctaagaacagagcgtgcatggtggctcacgcctgtaatcccagcactttgggaggccaaggcgggtggatcacctgaggtcaggagttcaagaccagcgtggccaacatggggaaaccccgtgtctactaaacatacaaaaaattagccaggcatggtggtgggcatctataatcccagctacttgagaggctgaggcaggagaatcacttgaaccagggaggtgaaggttgcagtgagtcgaggtcgtgccattgcactccagcctgggcaacaagagcaagactccgtctcaaaaaaacaaaacaaaagaaaaaacagagggtggccctatgaggagccttcgcttgtgtgggtggccagggacagcaagaggtgccagggccctaggaacagctctttcctgcttcaactttgggctccagatgggcgctttccagctcagtctgagcagcttcgggaagctgtgtcccatgggagacactgggagtcccctgtgctctttgtctcctgtcgggcccccacattagctctctggcctcagctctggcttccctccaatttgtttcccacgcagcagccagaggagctttcaaaaaggtaaattatttcatgctagtcccctgcttgaaatcctacagtgccttcccagtgctttcagccaaagccccagtcccttcctaagcccagcctggccctgcctccctggtgcatcatctgcacaaatgcctgctctctgacctccagccaccctgcacttccaatgcccgcggcttcctgcctgcagctttagtacagacccctcccctgcccagaactgcccccaccccaaggcttctgctgaaatgtcacctcctcagagaggccttccctggctgctctgtctaaactctgtgttgagaagttccttcttgatggttgttgaggagggaggctggagaagaagaatcaaagaggagaaatagaaagcaaaataatttgttcttggggacgggctggtgctgggcacggggaggcgcccgtctctggtgtgggcagctgggtagatggaggagccgtatttggaaatgtggaacccaggaagggagtgatctagagggaggggaaaggtggcgcgagatgcctgcctctcaacaggtagccagacacatgggtctgtcttggtcactgctatctgcccagtgcccagcacatcacaggccctcagtggtggtgtgtgggcatagagaattagaagctgtggacctctggatccggagctgaaaaccaccaaaggagatgagttggcctggccaggtgtgtaaaaggcagagtctgagagagaacgaccagagggcagagcccccgcaggtggagtcctgggggctggagggagaccattaggagaatcgcacatggctggcgcagcaggtcccaggcaaatgtggccactgggtttggcaatatgggagccagagccctagtgtcatctccctgccttctacccagcagttcccagagtgatatccccaacagtgtttgacaactggtacaggctcttcagcggccacagttactgggcaaggccttgtgagggtgactttggggcagctggccagcagtgggaggggaagcagtctcaggggtacctgaggcactgagctccgacctccaggtgccaatgccgcaccagggcaccgttcccctgcaggctcttacagggattaggggctggtaaggagcagtgattaggggctgactagcaggctggtgggcaccagcatgaccccttggtggtaccctctgggcactcatggggacttgggctaacagatggggaagggagcacattcagggggcttaggaaacatatttatgtagggaagcattttaatattttagtaacagaagctattaaaggacttacaaacttacttacatacactaaaacactatttggtcaaacttctgtttctttggcactttcctcctttattcttttttatttttttgagacagggtcttgctctgtcacccaagctggagtgcagtggtgcaatcttggcccgcagtagccttgacttccaggctcaggtggtcctcccaccttagcctcccaagtagctgggactacaggtgcacgccaccacgcctggtgaatttttgttttgaaggggtttcactgtgttgcccaggctggtttcaaactcctgggcttaagtgatccgccagccttggcttcccaaagtactgtgattacaggtatgagccactgcacccggcctcctatttttctgcttctgctttgtggataattggatgcttggacctcctgatttaatcttctaatttccttaactgtttactcctatttttcatcatcttgtctttttgttctactttgtggaggatttcttcacttttagcttccagttcttttcttacatcgtgacagttgctgccgcattctcttgtaaatttccgagggctcgttcttgggttctgaatgttccctcctttcaaggatcttctcatctctttgaggatattcatgtcttttttgttttggttcttaggttttcatctgttctctgtgctgtttcctcggagtgcttttgtctattctgttgttttgtccctcatgttagaagcatttcttttttttttctttttttttttgtgatacagagtcttgctctgtcaccaggctggagtgcagtagcatgatctcggctcaccacagcctctgactccctggttcaagtgattctcctgcctcagcctcctgagtagctgggattacaggcacacaccaccacacccaactaatttttgtatttttggtagagacggggtttcaccatgttggccaggatagtctcaatctcctgacctcatgatcctcgcaccttggcctgggaggccaaagtgctgggattacaggcgtgagccaccatgcccagcctagaagcatttcttaatgtctggtgttctctggctgttgtatcttaaaaaaaaaaggggggggaaactgaggctcgaggtgaccttgtgagctggagcagagccgggatgggatgaggaggcaggagcgtgtgcagaagagagggagcccccctgagctcgcaccctgcttcccgtggctgggaggggaggccgagatgcttggggagaaatggaggctccaagccagaggggctgtttccagcacgctcttactgagcgctgctgtagtccagcttggtgtggcggctgtgggcagggaggggagagaggtctgagctggctggcggcccactgggcccctcccctgagcctccaccggccctctcccagtgcgctgggctgggcaagcctctgatgtgccagccagatggagggtgaagtcctgatgcctgcccctaccctgggaattgtgatgctgcagttactgcccctgataacccctgactgggcataggaccagctggctgagccagctcctggggctgaggaggaagccatgaacttgacctggcactttccttgtctccaagcatcagtcaaccaaggatatggagggggtgtgtgcatgtgtgcacacatacacacacacacacacacacacttcaacctgtttatcccccttgagatttgctgacttgtgcattgggggtagaaggtgctggaaaaattccggtcctggttctcagtttccccatctgtccagtgggagcagctggactgagagacgcccatgtctcctgctgtggtcctgcaaggaggctggcgctcctgagtctgctccatcctggcctgtcaggcctgcctggatcctgccccgggttggtccaccactcactgttttgtttccaggaggagagggatcgccctcccagctaacacagcagaggggctgctgaacgtcattggcatggacaagccgctcacccttccagacttcctggccaagtttgactactacatgcctgctatcgcgtgagttgcccccaacccacaggtcctagggcagcattgatccctatgactaggaccaggcctgtccctcagcctgtgggggccagagaagttgctctgaaaccacagctgtctttctcaccattgtgtacacttagtgagtctctccagtgcctttaggcctcagttttcccttctgagatgtgggtgtgatggactgaaattgcttcaagttctacagagaaatggcagaatatgggagctaagaacacagggtcagaggcagtgcagggcttgaacccgggccatctatctcctagttcagggcttcgtgttgtgaggggaggagaggcctgaatatagggtgggggcggggagatgtggggaagattctccaaaaggctttttctttttcttgtcttgagtcgccagggaacagcactaggtaccgaaaaggcccagaaggggtatgggcgagtactagagagaaatttccatgactgctttatttatttatttatttatttatttatttatttattgagacagagtctcactctgttgcccaggctgaagtgcagtggtgcgatctcagctcactgcaacctccacctcccagtttaagggattctcctgctttagcctcccaagtagctgggatcacaggcacccaccatcacacccaactaatggttttgtatttttagtagagatggggttttactatgtttgccaggctggtctcgaattcctgacctcaggtgatctgcccgcctcggcctcccaaaatgctgggattacaggcgtgagccactgcgcctggcctccatcctcatcctgaagatgcaagaacttctggtgaccccttctcctgagagtggcctgatctcccctgggcagggcactttcttcccacgctgggctctcccagcacttgtgtgccttccctcacacattctagtaaccacttcattttcactcttcatggtgggaacttccagctaagcacagtccaccgttacgtgatcaacacagtggccctggcaggccaatttgtgccttgcttctggaacaaacatgcagtaataacaacgaaaatgttttgagcatttgtccgctctgctccaagcactgacccgggtggggtttatgaagtttgactcatttgtccccgcaataactccttgacctaggtgtcagagggtgactaaccaggggtcacacagcagataagtgtgggcacaaggatccaagtccatgactgtatcccacgtgtctcccacatccaggcatccctctggacttgtccagctgtgtccttttctctcatttctcttccctgccagccttaactccatcaccaacaaatattgggctactctgtcctaggcatggtcctcagctgagaggtcgcagccatcccaagacagaggggtccttgccacatggagactgcattctagtagggaatacagcaaactggctgataagccatatgacacacaatgttgagtagtgataaggacctgggagaaaaagaaagcccaggagaatggtggaggggccgttttaagataaggcggtctgggccaggtacagtggctcacgcctgtatccccagcactttgggaggctgaggtgggcggatcatgaggtcaggagatcgagaccatcctggctaacacagcgaaacgctgtctctactaaaaatacaaaaaattagccgggcgtggtggcatgcgcctgtaatcccagctacttgggaggctgaggcagacgaatcacttgaacccaggaggcagaggctgcagtgagctgagatggcgccactgcactccagcctgggcgacagagcaagattctgtctcaaaaaaaaaaaaaaaagataaggtggtcagggaaggcctctctgaggaggtgaagcttcagctggctctaaaccaggggagcgggagagacgcagtgtaggacagtatcggggaagagcaggcctgtgtcttctccggtggcctcagggaatgagggagaaggaaggtgctggggaggctggcaaggcctggaggatgcaggccttgtgggcaggacctgggagttgcgatgtcactctccgtggcaggaagctactggggcttcgaggggagaagtgatatgctttgatttaccttcttaaaagattgccccaactgctgggtggagaacaggatgacaggggcaagcatggagacagggaggccagttagagatggcgtgattcaggccaggatggaggggtgagaactggtatgcagttccaaagtagagctgataggacttgcccagtgtctgggatcttatccagtggatgcccagagcttgggtctgggggatgaagtgggtttaatctgccaagggttggggatgtcatttgctcctggagctcccaagggacttggggaaggttgttcccaacccctttcttcccttcccaggggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgagtgagtgatgggcctggaaggggccatgctgagggtgtggctgggaggctcagctctgagactggaagggcgaactgctgggaatccctgacccaagcaagaccttgttcttgcccccagtctggtccatggcctcagaaagatgggtttaactctgtcacaagagacgtggttcccatcctccctttgccgttatgttcttaccttgggcacaagtgtttggctgtgtcttgctctggccacaggcctgctgtccaggaatgttaacctgcttagccacccaggatttctgaggggtctcccttgtcactgatgctgatcagatctctaaaggccctaaaggtcctgctctaacttcataactgaagtgagtctggcccatttctagccccctgcctgggcccccatggatctctaagtggtatcacaaaaccaccctgccccattttctgagccatgattctgatacatatagaatgtgaacatcatggcaggcccaagcttagcaatgctgtccatctgggggtggggagggccatgttgacaccccacacctcccactaagatctaggagcacccagctgctttaagagctagagggacatgctagggcctgggggcatctctgccagtctttcctctgaggcagtgggtcagtgggggaggagggtcctccccaaagcctcctcttcctcctctgtcccagtcccagagctgccctttaggccttccttttgcctcaggcccatccctactcctctcctcacacagaggggacctcaccccagacgaggtggtggccctagtgggccagggcctgcaggagggggagcgagacttcggggtcaaggcccggtccatcctgtgctgcatgcgccaccagcccagtgagtaggatcaccgccctgcccagggccgcccgtctcaccctggccctgacctcctggcctagcagtggggctgtacctgatctcccctgtgccccacagccccatggtgtccccttgagcccactggcatgaacttggggcttcatgaaacaactggagacctcctaggcaggctcagaacttctggagatgttctccccagggacaccatgcctttatagccaccctgcaggaagctcaacaccaaataggaacgtaactattgaaaaaaaaatctaggctagattctgatcagcccatagtcctccctcgagacccagtggaccaggccccatcctgtctgggcctgaataggtctgatttccaagatttctgaggggtctcccttgtcactgacgcagatcagatctctagagtttgtgcctcatggtgcacagcctcactgtgtgatattgggcaggtcacactgctgctctggttatgcaccaagacacctcagttgtgcactgtcacaaggagatgatcacacttacttcattcctctaccctcaggattagtaagaaccaaagagctacctgcacgcatttcctctaatcctcgcagcagcctgcaaagcagaactaccattgcttagtcccatttgacagatgaggaaactgaggtggagtgaggtgcagcctcttgcaaggcacaaaccctggatttgtatccggggacatctagttccaaagcctgtgttcattcattctttcttaaacacttcagaataactttattggttaagagtacctaatacattagcgagatacttcccaatactagtgtgagttctattttagatgacgtgttaaacggtcctccgtttcctcatctgcgcatgggaataagcctaccatgagtgttgttggaaacaccaggtgagagaagggtccgtgtcatttactgagctcaggccccgtccttggtgctttacacacatggcctcggcaaagcctggccgtgaccctgtgcaatagctggcagggttctttctgaaaagggcggaaactgaggccataagcagagcagttttccgcaggccatgtggttaggacatagcagttaggatttgaagacactgagccctgttttgtgctggcctcccatggggggtttgggtgggacagcaggcaggtaggctgggaggtctctccatggtgctggtgacagagcctgggtgggcatctcgcccacagactggtcccccaaggtggtggagctgtgtaagaagtaccagcagcagaccgtggtagccattgacctggctggagatgagaccatcccaggaagcagcctcttgcctggacatgtccaggcctaccaggtgggtcctgtgagaaggaatggagaggctggccctgggtgagcttgtctcccacccatagttgggagaaatcacaagaaccagggaccatggtgtctcctgagttctgaagtgtgtctttgttgggtcttaaggcttggaactggaatccccctgggccaggcgtggtggttcatgcctgtgatcccagcactttgggaggcgaggcaggaggattgcttgagcctaggagtttgagaccagccagggcaacatagtgagatccatctctgcaaatacaaaaaaaagtagtcaggcatggtggtgcatgcctgtagtcccagctacttgggaggctgaggtgggagaattgcttgagtccaggaagtcaaagctgcagtgagctgtgataatgcgactgcactccagcctgggtgacagagggagaccctgtctcaaaaaaaaaaaaaaggaagaaagaagaaagagaaaagaaagagaaagaaagagaggaaggaaggaaaaagaggaagggagggagggaggaaggaaggaaagaaggaaggaagggagagagaaagaaaagcctccacttggtgttgggagtcctgtgctgagcctgcttctggctgtgatttgctgtgtgaacctgggcaacactgtgtcttctctgggcctctgtttcttctattgggatgactgagttggagccgacatctcaaaagtcgcttccagcgtgatgatgaatgggcctcctgtggagggtgcagcatggtggagaagtcagggctctggagtcccactgcccgggctcagagcttggttccacacttcctgtctgaccttggtcacattacttgaatctcctgagcttcagtccttcatcataaaatgggtgggataatagttgtgaatattagataatgtatacaagtcacttcatatactacctgacacatggtaactggctaatgagtgacagctaccacttagataaggacttggagggtaaaagaccaggtttccccatgctgttgaagcaggcagcatgactaggatggttcaatctccacagcatggtcaaggcagggcctgccggggccctcccgctagggcacccatgacctggctctcccccttccaggaggctgtgaagagcggcattcaccgtactgtccacgccggggaggtgggctcggccgaagtagtaaaagaggtgagggcctgggctggccatggggtccctcctcactgcctcctcccatacttggctctattctgcttctctacaggctgtggacatactcaagacagagcggctgggacacggctaccacaccctggaagaccaggccctttataacaggctgcggcaggaaaacatgcacttcgaggtaagcgggccagggagtggggaggaaccatccccggctgtcccaacttcctgtatagagaggcagaaagcagggcgggtcccaggaactcgaggggtggccccaggcccagacatggggggaggaatcagcatggcctggggccatccctgccagccacacacctgctcttccagatctgcccctggtccagctacctcactggtgcctggaagccggacacggagcatgcagtcattcggtgagctctgttcccctgggcctgttcaattttgttccaggaaggccaaagagggaagaaactttagggattgggcatcagcccatgccgcgtcttttagatatgaaatctcttcgacaccctgggaagcaggcattgccgtcctcatcttacaaatgaggaatccgaggcccagatgtgctgtggcttgactgggattacccagctgctaaccagcagagctggggccctacagctcatcagctggagcagaacgctccattactctgagggaagcttccacacttccaattctcccaactctgccccctgggcatcgcataggaagcaggagtccctctggccagcatgttctctcttcctgacacctggcccttgggacccctgggcattcccctgagcgccatcttgaagctttccaccggagggtctgttccaccctgcctggctcccatcctggagtctaaccagggtcaaggccctccttccgtcctgtcgccaagccacaggagcagtatcaggccttaggaaaaagccgccttccccaagacaaggacagcaagaactcagggtgaccatggtcaggccagcacttatccatctgccaggcatatgagaaggggaggggcttcggctctgatgttctgatgacaagggggtcttggggcttgccttagggacacgtggcacctgtggaggttcttggaggcatgtgggtataccatgggctggaaaaagatccaggagtcatctgcacagatatggtggctgaaggagaagcagtggccccaggaggtggtggagcaagaagggcctaggatagaacccagaaggacaatggtatttaagggaccagcaaaagagacaagtaggaggaaagtcaaaagtgtggtgtcacagaaatccagggaaaaggtttcaagaaacagtcaacagtgtgaaattctgctatgcaagtcgattatggtcagagctaggaaagatccattagatacaacaagatggtggtcagggatcgtgccaagaacagcttccatggtatgttggagtagccagctcccagtgggactgaggaacaagcagggtagggtgcagaggggaaggctggagagggtggcagccggagggggatgttgctttcttggctcccacccccacgcccccaccggctgccattctgcctggttcccatgtctggcccctctgctgcctttgcccagctctggtcttcaggatgggctggattctggactttctggttacatagacttgaacaagtcacctaagttctgaatttatttccccctctgcacaaggatcagatctttcagatctgtttgaggctgctgtgaggatcaaaggcgggtgaacgtcaatgtgttctgactatttatgtaagagtaaaaggaggctgattctctcctcctccctcttctgcaggctcaaaaatgaccaggctaactactcgctcaacacagatgacccgctcatcttcaagtccaccctggacactgattaccagatgaccaaacgggacatgggctttactgaagaggagtttaaaaggctggtgagtgggtgtgagccatactggccttgactcgggtttgggagtatggtatctacaggtccagtccggggcctggaatctttggagagagggagtgagtctgcctcaacagtccaagacaagcccaacctagacactttccacagagaagacatctttgtgttgacgtcctgacctaggaccaggtttttgatcctttgcttgggttgagtgcctttaaagaatccagtgaaagctgtcaaccctctccccagaaaggtgtgtgcagcagctatgaagtcttgcacactctcttcaggttgttcttaaatcccaggctgaataagtccattcctgcacgtgtctgcgaggtgtctctggccccctacatgccaccctgtctctcaaaggtttctccaacttccttctcacagccctttttcatgtaatgacaaattaagaacacgacctcatggtctctactctggcacttgctgccgtgtgacagtggacaaatccttccccctctaagcgtatctgcccatgttgagtgaagaggatggactatcactacattgctaagagctgccttctttgttctctggttccatgttgtctgccattctggcctttccagaacatcaatgcggccaaatctagtttcctcccagaagatgaaaagagggagcttctcgacctgctctataaagcctatgggatgccaccttcagcctctgcaggtaggttcctgtctgggcttctgggcagttgccctgtcctggccccagtgtggctttctgtgggacttctagcaagatgcccttccattcttgggcagcgccatgaatgtgtgatgactccctggtttctgggccctggctgggagcagcgtctcattagatcggtttgttttctataaaagttcttgagaggctgttctaaggggagactttctgaagcccagtcccaaaggtctgggcagttggggacacctccatggctgcccaaagccaagggcagggagaggggcccaggcctgttctgctcctttcttcctatgtggtcttggcaaggcatcttcttgccatcataggaaggagttcctttctggttctggtgttctatgatttttacaacatcctgggtactacaagttgcctgatctttttgcttctctgaaccaacgagcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgcagcaggtggcatgtaatttggtggtcttgggcgggccgatgtgggcaggatgagcatggagggagctgggtcagcctgctcagcagcagggcctgagcctaagggtggctgtgaatgccaggccagagatcccaatgctgtgggccaagaggggtccagaggctgtcctccttccagaagaaataaggcttctctggttgttgctcaaacattccctgaactctcagcccctcctaactctaggttttaaggagtaaagcttccttttgggttcctgaagctggcagttggggtgagagcagatgagatggaagagggctcatcagacactggccttggagggtgctggcctctgcagaacgccagcatcttctcagaatcgtatgttctagaagcctggggcaagtccggctaattgtggacttggggaaaataaggcccaacccctgtttttgcaaggttaaggagaaataatcttaaaccagtcacacaaatcatcggcatttatttcctgggtcctaggtgtcacttatcctggtggacagggcagaggtggtcagatcgttttgagccaaaatcccttccctaaaaatggatctgtggagctccatgagggaacctcagagatgcacaatgacagtttagctaaaatggcttaaaaaatgtgaattgattgtcagctctctccatatctgctgaaaaaaggtttaaaatttttaaaaagtttaaaagtgttttctaaaaaagggacaagcaggtctggacccagaagattgggctggagaggaggtgttggtgttgggacagggtccctgcccgggccgctcgcgagaggagcgttcctgtgtgggctgctcactgtagggcaggccccgcccaagtcccggcgccagctcaataaataacatcttgtggttacagtgtcttgaaagtgtacctgggcacggtgcgaaggtggtgggaatgtgaagcctgtgggtgtgggcagagggctttcccggagtggaggccacagaggcctctggggagccttctcagtctggcctggtttatctgggacatggagctcagagaagaggctgctgggccagtgccagggttccccctctgggaggggacagaaggtctctcgtccagccttcttggacaaggtcagattcaagacgaggtggtcccatcgctgctctggggctggttgccagcttccttgtctggggcgcttccctccacctgtccttctggagaggagagaaagaggtttttcttgggcacatatacacaaagtaatgcacagaaggaggtgtgaaagggcccagccaaactgatagcagtggatatgccctggggagcaagacgagctggagctggactgaggtggtggtggcctatggactttagcctggtctgtaacatctttttacatggaaatacacatagtgtttgttagtataattaagagtcaattaagggccattatggatgggtgcttaaagcatcaagtgaagggctcttgaaggttgctttgtttgtgcaggttccccagagggagaggccagatgttaagtccccagtgtgtcacaggtgctcagcaaatggcagctgttctgtttgtttgttttttttttaatttttgtatttttagtagagacggggtttcaccatgttggccagactggtctcaaactcctgacctcaggtgatctgcctgcctcagcctcccaaagtgctgggattataggtgtgagccaccgtgcccggccaatgttcttctaagagagtaaagagcactgaaccaggccagctcagggagcgccagggtgtggcctgcatcagagtctgtgggggccaaccgtgcatcatggggtgtgtgttgtacctccttctcaaatccatcctgtcagacatcttggtggggtgaggggcagcagcaggctcacagagatggagcacctcactgaggggagtcaggatacaagccaagtctcctcactttcagcttc

SEQ ID NO: 11746 - DNA, 13675 bp, Human
caattctcccacctcagcctctggagtagctgggattacaggcttttggcaccatgcctggctaatttttttgtatttttagtagagatggggtttcgccttgttggccaggcaggtcttgaactcctgacctcaagtgatccacccgcctcggtctcccaaagtgctgggattacaggcgtgagccaccgtgctcagcctccagtgcttattctatcaatctgcaaacgcaggaagagcaacaggacagtacaaaagaggaatcttgtaagttcaggtatttggccagaataggcctgagcgtatttaaaaatccaggttattaggagaacccaaggtgtttcaggaaagaaaatatgtggcagaaaaaaaagtagagggaaaaaagcattagttcaggatttgaatagtatgcaattaaccagtgatatgctttaaaatctccctttagcctttatttgtgtggcatacaatgaccagaccaagccactcttatttttcctctagcattctctggagctaattaattaatagatatcttctgtcagttcttctcaagttcagcaggttatttgaagcattaaccctcataggctttgagaaagaaaagaaacagtctgcaagacataattgcaaatgtgtaaaattatgccagtgaaaggtaatatgtaaaaatgaaatagctgagctaggactattgggagacactctggttttttaaaagacgttgttaacatttgtattttcagttttaaaataaacctgactgattcctcaaagcctagctttgagtaaaatgacgatatagagaacatggagacagtgaagatatagtaatacctgcactgctgcctagaggattgtgaattttactctactttttgttttgtgatcatttacaagctagtgatgaaaggagattttacatggctctaaagttgattcttgtagagtgtaagtttgaatccacaaacccccatatactaaaaaatgttgtttacttgaagacaaattagtctctgagcccccttctaacttgcctaatggggaattcaatctccatcacggtgagtgcccttctagtttagggtcctcaacgttctttgggcagggagagactcacccagagtagcctagatggggacagtcctcctatgaccagcccacctatatgccttacatgtgttcatgttcagacccacgtatcctctgaggttcaggtttgttactcctgtgcccctcacagcctgggacaaagctgagaccctctaactggagtacagtccaccgagctcacactgcagcagtttccttctagagcactgtgctcaaaggccctggtctccctgccttctgctctagtacagacccctagaggagctcaggattcttgaaaacaaagatcacgagaaagagttcaccacaaaccacactcactccccgccttccttctgcatgaagcttccctcgtgcacagcggcacaaaggcctagctacgtgcttggtcaagtcagagagaagcaagaggaaagcaacaattcaaatccatatagctataaattatgcagccagaataattttcatctcttggccctctagaaaagcagatatggggtcaccaaaaatgcaggatctggccatttctttcccaatattccctttcttcatttttacagctttaaaatggaaatgatctctgaaggggttaagcctcatccattcgctggtgtgaatattctagttagatgaacatccttcttaattaccaaattagagatatttgattgggatgggtggaaggaggagagatgggatggaggtcaggactaaagggggcaacccacaggcagaatgggagagtggggaagcattggctagcagaggacaaacaggagggctgcaaatagtggtggtttggaaggtggtaaacctttgatttccccaactcacggcctctctcttaatccagaccaccctagcccagctttgtgttttcccgcatctttcctactaaaaatacaaaaaactagccaggagtggtggcaggtgcctgtaatcccagctacttgggaggctgaggcaggggaattgcttgaacccaggaggtggagattgcagtgagctgagattgcaccactgcactccagcctgggcaacagagcaagcctccatctcaataataataataataataataataataataataataataataataatactatagcatgcttttttccctgagattgatcaagagactcagatacaagcatatacagtagttactcagaatttcaagggatataatggtaggggagacctctagatgacaattacaaggaagaaaacagatttttttatataacttaccttctagctaattctcccacattaactagggcaagaaattctgaaatacaaatgtgtatcataggagagattatagaaatgcaaatgattagaactaaagtaatgatgactgagggatatgatttccttgctgggtacaaacgtgtcacagcactataggagagacccagggaacagctgttatgtgactaaggaggtattagcggcatagacaaaggtacatgtgcttggttactcaactttaaaaaacaaactatgacaaaacgctggaattgtaaagcagagtcaataatcagcaggaaatctgtacactctttgaaaacaacccggagcaaactcaggaaaagtgtgtgctatgaatcaaaaagaaagattgtgtaacaccttgcctttgctgccaccctccactctcatctttcttctgcccacctttctgccttccgctaccgctttttttcttttcccatcactacccccctccaacttcctatacagagaaactcacagatagcagttaactggcaagtaatataggctagtattatcaaaaacatatcttttcaaagatggtaagtttttccagatgaaaacaagacaaagaaaacccacatatattgtggcaggttaggaacaatctaggaatttagaaagccagagataattcaaactgaacctactggcattcttttattcttctcgtctttgtttcccttatctatctctctttgcaaccgaattgccccaaatctaaattgtgaagactgcaacttctggagcatctcctataagccaaaataaatgtatttcctttgatgcttgaagcaacaaataagatagatattacaacctttatcttgaaaatgaaagcactaaagctcaaagaccttcagtgatttgcccagggccaccgagctggcaagtgggcggcagtggatcttaccccatatttgtctgcattccattcatcacagcccacggttccccccagcagacctcattgcctcttatccatgttattgcaagagctttcctgctttcagtctcatatttttctttcaacccagccctcacagtacttacaatataatttgcccaatcaaagctttcctgtctgaaataagttgggacatctatttgatctgtactttcagaagaatatggtggacgggaaaggggtcataaggagtgcaattacagaaatcaagagaaagcagaggcagtgaatgacaattgactaactgaattaggactctggaaagttgaagtggagaagagatgcgacagaagccaaaaatgttagaaggaagggaagggagtgaagagatgtggcagtgagccggcaaaatgccatgcaggtgaaaggggtgacgaatgagggaaactttaaaggtctaaaaggaagagcagctaataggatgtatataaaacttctagaaaagtctaccattttgagatagtaagtgtaaaaaacataaatgacttcaggttggctttggacacatttatagatcatagtcttataaaatactattaatggaagcctctgatatttggaataaactttaatttttctgaggtgaatatcatcaagaacagttatcctttcttttttagaggacactttgcagctatagtcagagatagagttacaggcagaatggttgagaatctcaccctatggggaaaggcagcgtagctcaattctgtctgtgactctgccactgacttacgtggtcagtttacatgttctttctaagcctgaggtttaatatctgcaaaatgaggggaatgataatttctgcctcagagaatggttatgagaactaaaaaaatatatatgtatgggcttggcacagtgtttaggacatggtaagcatttacatgcttaccatttgaatatgtaacaattgaataattgttgagtatctgtgagccttccctatgattttgaagtaaggaagaaaagcaaggaagcaggtaaggaagaaaaaagagagaaagacagtaaagaagaaagggaggaagggagggagggaaggagggaaaagaaagggagggaaaagggatttaaaaaaaaactggaaataaggcaggagatttcaaacaagaaatttgtagtgtaaggaaagtaaaacaaactgaacatcaaaattgctcggtaaacatgaaaactggatgtgaaaaattaaattaatagaaatgattgaaacagaaagtaaccaaataatctgacaagttaatgtgtcattaggtaacaatttgcaaggaagaaaagacaataaaatgaaaaaaaaatgtgcagatgtaacatattccccaagatattcccaaagtgacactaggcactgtcaaagataaaagcctagtgagcttgaatttacacagcttagacattccagcctagtggtccaataagaaaacaggaaggcgaggactgcaattagatataaaggtggttatggaaagaagcaccatgcttggactggtttaatattgcctcactatttcataacattctcatgtgtagttactttaaataacatatttgaaacaatggtaataaaaaggaaagtgaaaataatattaataaataaaagaaaagcagatattatgaagtcagttaaacatcaggcctgaccttttactatttgtccgaaagcatcgggagagttaatttagccaattttaatggaaactttaactgcttcatgctcaataaggctatgaagttgttccctgtggcagctctgaaagacaactgtggaaaaccagttatgcctgagacatttatttccagccatttcctttgcctgcctgaaattcttcttcatgtcctcaatctctcgatatactcttaaaaaatcattatcctcttcttctgacctggaggaattctctttctctttcagactctgaaagagagcagtcactctttcgtgttatatcgacaatttggtaacagctgagaactacaatctctatgaagggagaaaaataccttttcccccatccccaaattcttatcttaaattccacatagtaaagtgttcaaatgatattttgtgaatagttttatcacggggcatagttttatcaaccaggctggaggctagtgaactgtggcccgtgaactggatacagattgttgacaccagctctcttagtgtcattagtcatccgagagtcttggccatttttatttctttaagggaagagtttgctcagatatgagagggttagcatcaaaaaataataggttgtcttgataagtgttttaggtttttcataggaaaagatgttataaacagaaaacctttctttctctttctttttttgagatggagtctcgctctgttgccaggctggagtgcagtggcgcaatctcagctcactgcaacctctgcctcccgggttcaagcgattctcctgcctcagcctcccgagtagctgggaccacgtcatgtgccaccatgcccagttaatttttgtatttttagtagagttggggtttcaccatgttggccaggatggtctcaatgtctagacctggtatgatctgcccaccttggcctcccaaagtgctgggattacaggcatgagccactgctcctgtccaggaaaccttatttttattatacttactattaacctttgcttcatggtctaattttcatcaggaaattctgtcacttatatagagagagctattttgtcatttatagaaacaagtttaactctttgtccatatgatgccagactatcctaccaagtaaaattcaaaatctagcaaagtgctatgtgggaggagcaatgtaataaattgcaatatgattttctgtaccttcttattagaaaatataagaaaaatgtatattcttttccaacaacaagttcatatattaattaataatcattttaaggccgggcaccgtgactcacccctgtaatcccagcattttgggaggcctaggtgaacagatcacttgagtctaggtgcttgagaccagcctgggcaacatggtgagatactatctctacaaaaatacaaaaaaaaaaaaaaaaaaaaaaaattagcagggcctggtggtgcgtgcctgtagtcccagctacccaggggctgaggtgagaggatcacctgatcccaggaggaggttgcagtgagccaagattgcatcactggccaggcgtggtggctcacacatgtaatcccagcactttgggaggctgaggcagtcggatcacctgaggtcaggagttcaagaccagcctggccaacatggtgaaaccctgtttctactaagaatacaaaaattagctgggtgcagtggtgcgtgcctgtaatcccagctatgcgggaagctgaggcaggagaattgcttaaacccaggggcagaggttgcggtgagccgaggtcgcaccactgcactccaacatgggcgacagagcgagactctgtctcaaaaaaaaaaaaagtctgaaaagatttcttaaagaatgtaagatttgagtgagttagaagagtcatagataagtgtgcttagcacatcaaagaacttggggaaagttagaataataaaacaaggaagaagaggccatagcattcaaaactggttcaaataccatagagacaagaccaatgtttctcaaccttgttcttagtagaaacacccaggaacctttaaaaaaaaaacactgactcctgggccacactttcaatggttctgatttcagtggtctggttgggacctaagcatatgttttttttttttttttttttgagacggagtctcactctgtcacccaggctggagtgcagtggcataattttggctcactgcaacgtccacctcctgggttcaagcgattcttctgcctccacctcctgggcagctgggactacaggagtgcgccaacacgcctggctaattttttgtatttttagtagagacagggtttcaccatcttggccaggctggtctcgaactcctaaccctgtgatctgcctgcctcggcctcccaaagtgctgggattacaggcatgagccaccacacctggccagcatacgtatttttttttttttttttttttgagacggagtcttgctttgtcgcccaggctggagtgcagcggcgtgatcttggctcactgcaagctccgcctcccaggttcacgccattctccttcctcagcctgccgagtagctgggactacaggcagccaccaccacgcccagctaatttttttgtatttttagtagagacggggtttcactgtgttagccaggatggtctcgatctcctgacctcatgatccgcccgcctcggcctcccaaagtgctgggattacaggcgtgagccaccgcgcccggcccagcatatgtattttttaaaagctacctgtgtgtggtggctcacgcctgtaatcctagctacttgggatgctgaaagtgggagaattgcttaaacccaggagttagagaccagcctgagaaacatagatgcatctcaagatatgtaagtatatgtgtgtgtgtatatgtaatgtccatgtatatgtatatatgtatgtaaatgtgtgtatatatgtaatgtatatgtatatatgtatgtatatataatatatggatatggatatgtatgcatatatgtttgtgtgtgtgtatgtgtgtgtatgtatgtgtatatataaaagctctctacattgttttaattggcaaccagggtttgaaatcccctgcatcaaggcagcacttctccaagtgtggtgcaccggggcccgggggttccggaaacactctcacatggtctgtgacgtcataactcttttcatagtaatgctagggcattgtttgccttttccttgtgttgatatctgcagtgattctctgtgttgacatttggtgcaaaaacaatgatgggtaaaactgctggtgcctcagcacacatcaagacggtgacaccaaattgtactaattatcatcatttgtttttgcagctacacacttgcagttaaaaaaaaaaattagtttctcttaagaatgtccttgatgatgaagcaggaaaaatattaatttgattaaatgtcaacccttcactttgtgttctttgacaaaatgagaattatgcatgaattgtatctgctgcatactaaagtatgtcttgaggaaaaacacttgtgtgattgagttgtgagctaaaattagccagtgttttcgtaaacactctttttacttgaaagaatggctaacacacaaactatacagacttggatatttggcagagattttattgaaaataaatgatgtaagcctgatacctcaagggaatagctgtcagtatgtattattgtcagcagtaaaattagagctttcatgtacaaattacattttgaaatacatccacaaccatgggatttaacagcttcccactacttagagacttttcttatgagatcagtaattataagtatttttatattgtataataaaatcatcaacatttgtaagagctgcataatcaattagtcaatattttccaaatgcctggatgtacaatattatgcatgaacaaaagacccctatttgatcacaagacagagcagtggaacttcatgcagcacacaaaaacaagttcattgatgtggtttcagtttctacattgcatattgctttaagaaattatcacttgtcaagttttggtgtcatatcaaagaaggaaattcaacattatctgagaaggcgattaaaatattcttctcttttccagttgcatagctgtgtgaagtatgtgtggaatttttctttaggaacttaaaccaaaagaagacattgccacatggaattcagaagcagaaataagaatccaacactcttaagccagccattaaagagatttgcataaatataaaacaatataactcttcttgctttgtttttgttttgaaaaaatagttttttaataaaaatattttatgtcaacatgtgaagggtttataagtagatatttttgtaatgtctccattttaatttttaatataatgaatagtgatagatagaatgaacacacatcaacattttggttctcattaatttttaaaaatgtaaaggagttctgaggtcaaaacatttgagaactgctgctctaaaccgaaggggcaggtggcaaagcctggctagatgagtgctgtaatgctgttgagtaaacagaaagaaaccgagggagcggaaatggaatttaatacagaagtccaaaggaagccagtaagattttgacatagtcaagcagaactgaaagaccaaagagatgattttcacagtggagaaaattacagtcattcagctatgagatagatgagtgtgacctgaaccagagatttgattctgatatgtagagaggaagatgcaaacattttgaccgctgtagggaaaattgttctgatttttacagcaaggagtcagaatttactctgagatgctgtcattgagtgactgctactgacacatatgtgatgatatctaaggggttgggaagaggctaggtcttgaggaggaatgttagaaagcacatcatgctttgcttggtactgttgttgtttattgcctaaaaattctttgtgataacttggctgactgctatctttatagttatatcaggtgattgttatgtttgacacactgaatgaggatcttttttttttaaacatttatttatttattattattattttttgagaaggagtctcactctgtcacccaggctggagtgcggtggtgcaatctcggctcactgcaacctccgcctcccaggttcaagcaattctcctgcctcagcctcctgagtagctgggattacaggtgtgtgccaccacgcccagctaagttttgtatttttagtagaaacatgttggccaggctcatctcaaactcttgatgtcaggtgattcgccttccttggcctcccgaagtgctgggattacgggcatgagccaccacgccccgcctgaatgaggatctcctaatatacctccttagttctgtttatcctcttggtcttgggtgtgttatacaatgtacatttccaggtttgatatctggaacagtgggagaaacctgtccctatggtctgaatattggcatccccccaaaattcacatgctggaacctgatattattaagtagtggggtcttttgtgaaacaagtcattttataaggctccaacctcatgaatgggattaatacccttataaaaggggctgaacagagctgccttatccttctgccgtgtgaggatgcagtaacgaggtgccatcttggtagcggagatcaggctttcaccagacaccaaatctactggaaccttgatctcagacttctcagtctccagaactgtgagtaagaaatgtattgtctttataaattacacagcctggggtatttttgttgtagcagtaggactaagccacctaccatgaatctcttaagtggagctgaaaccatgaaagaaggactctcttctccatttggggtctaaggagcatcaaaccatgctcagggaaaggtagagaattgagcttatgagctaaaagttgtagagaacaagatattttcaatctttgggatatgatctgtttttgagaaagttaagtttgttactttactctgtaacacttaagtcggtttcatataatacatacaagggctgattgtggcatgctgctcttgcttaaacgtgcttcttaggaaatacctcttgaaagtcagatcgccacattatatttgcatcatatgttatgcctggagtattgtcctttgaaatagattggacagagtatgctattcacagaagagcaataagcaaccagcttgatagagttacagaattttagctctcaaggagagaatgccaaagtaagttatcatagactactcttgaaaaataaaagagcccgttaagatcaagtagagtatgaaaaacgaaaaaccctctctccttgactaaacactcatttattaagcagtagtttttacattctccaggtacagctgaaaagtttttctatagtctcagaactaaggtgacatttccctgaccacctatttataacttttcttccaatcctttgcagtcatcagattcatgcatagtagccatgtatatagttgtggattgttgaacttgtgcaggttgtcatttgcagctgctagaaaaaggacatgcgctctacttcttgagggatgaatgtaaaaagtcttttaaaaaatgttacttaatgtcatagatttcctaatatcaggttcattctgtgatgctatttaagagaaaataatttcaaatcagcctcagttataatgcatccctgaaattatgttggagatatatcaagatcaatgaggtcaaaacagtcaatgaatcaattttctaagaagggcaatgctgaagacagtatcaggggctcacgaagcgactgacacttcaactttgtaatatactatgatgtttaagtaatttatcagtgatctcaaagatctaaaataatagtacttatggtggaataataaaattgtatgagatcataaagacatttgcattcccaaattatttattgtaagatttctttctgattaataaagacttctttacatcattaaaacactgccactgaagaagtacttctctggaggaggcacactaataagatttaacttgctcaatgcaggtgggtagatggtgacagaggaagctaatggaagttctcttctgattgcttctgtttctttagtgacataggatatagacaattgaaagtgaggatatggaaggcttttagaggtttgatgttctaggacaaaagagaatatttaaaataaatccatagttttattttaatattttaaatctatagttttatctataggtgcagtggctcatgcctgttatcccagtgttttgggaggatgtggtgggaggctcacttaaggctagaagtttgagaccagcctgggaaacacagtaagaccctccctgtctctacacaaaaataaaataaataattaaatttaaaatgagaccaactatgtgattgagagtgttttctgatcaatttagattcagagatgctgatgatggcagcggcggaccgtccagggcagccactgccatcacactggctgctgtgaggaggacgcaggaaggaggcagagctgggcctggggcattgccatgttccacactgccggtgggagccagggacaagtgggagacctcccagagcctcctgccctgggggctgccacgatggggccaggctaagccacctgtttgcaggggagcagcccagtcaggcatggaagggcagacagagaggggcccagtgaggacctggagccccaaccccaggctgtaaggaggtgtggccggggctgcctgcatgcgccatggagtgggcaggagtcccgccctcccaggcacaggacccaggcatctctgtagtctgcaccctccgggcccaggaaagccctctctgttcctactgcctggcctctccccactccaggagcccactctgatattagagtgcggttggggccaagcccaggtgctgtcacagcctggcccggtttgcacacactcggggaagtgctaacacaccatgcccctgaccacactatgggcaaattaagctaatatataaagagtacccttaaagcaaaagaaaatgccaaaaaaaaaaaaaaaaaaaacccaaatgtagaaaaaggatatataaacttacctaaaacaaaataaaaatttaaacatatgagtgataagtgacaggaggcagtcaaatgcctaggcagataggggccggtcccttgtgatatcccaccttcaagtcaaaaacagcctgaaggctgaaagactggactgctggttccggatgaaaaacgtgacccagagtgggaacttccgttcctgtttgcctgtcctttcctgattggttctttctgaataatgctttttaaccaatggaatgttacgttttccaatactacctttggcccgcccctcccccatctatgagtataaaaatcctagactcagccatactgggggagatgacccaacttcaggtgagagactaccttcctgtcccctctccactaagagctgttttgtcatttaataaaattctctgccctgatcacccttcagttgtcagcatgacctcattcttcatgaatgtgggacaagagctcaggacccagcaaacatgggtgcctggaaaggctgcaacactgtggccctctgcctttgccagca

SEQ ID NO: 11747 - DNA, 148405 bp, Human
aaggaactagcaggatcctaagctttggaattatactctctacctacaggatgtttcctacatcatgtgacactctgtgttcatatgctggtgttctctcttctgagtgtgggaactccaaagagaaaaatattgttcctcctcttccttggatggtgaaacggcttctagctttcgtcactcctgctggtgacaaccacgggttcgttccagaagccattactgagcacttgctatgttctgagtcagctaatatttaagcttcattcttgcccctgagtggggtgcatgccacgctgccccctcatgagtgagcctggcccagtatgtgttgccaagtgagatcatctgtccttcggggaggctgtctgaaatcatgtctaatgtgacctgcttcttttacattttttagctttctggctccctcaaaacaaacaaacaacaacaacaacaacaacaaacagccattgttttgagtccaagtgcttcaaaaggctcctgcttaaggactgtgctgtggtagacatggcggttccttctagcccacatgtggcctagaactctgtcagctctgtcaggcactagtccccggggagatggcccagcgtccatggggtgcgctccagctgctgtggaaaacacagacgggtcatgaagctgatctcggtggcatctttccgcagcagctgtgccctcatggcaaggccagtttggtgctgcgggaaagctctaaagccagatggcggcctcgtcaggggacctggaccagcgtgggcccagcaggaggccaagcatcacgtgaggaaggctggagagacccttctcagggaggactgcaccagaggcccccagcggtgacacccacccctagaggaaaccatggagggagacagcccccaccttaatggcaccacccccagggtccagggaggctgccatgcccctggccccgcagctcagctcctcggggtcacctgttccctctgccagccaccaactgccattccaggatatggtgttctcactgataaagccattctgggcagatgacatctcatcccgttgttggacgggcggacgttgcaaaaggcggcttcctaggccaggcctgcaggagcttggcctgggatggtccagcctggctggtgggcagccccgaccttctggcagctgcgggaccgcctgggcgcccccctgcccgcgccatcccacgccctcctagccgctgtttgcggtgactcacctcggttcccaggaacgttgttatttttggccctggtgttattaagattgtgcccagattccctgcaaatcggccactaagcagcatggggccctagtgaaagcacgcggagaacagagggggcagcgcgcttcgggaggctccccggccttggagagctccagcctccccggggggcggaggggccggccagaaggactcctgcgccccacacccgcagcgccgacagggcgtgcgccctggctcagcgctccccgactgctcccaacccaggggcacccagggccgaagcttcctctacagagcctccccctccttaggaaacaaaacaaaacaaaacaaaaaccaggaaaggcaaattgtgtagatgccactaaaaagaaattcccgcttagtattgcttcccctgcacccagcgacttttagacaagcagaagaggagatgccctgcccgcgactaaaccggactccctttcatttactaccctctcagcgtgtggcctgatgtccaactctgggctctgaactcagctctccccggctgctctcgaccccggggcaaccaggggtccgcgccggccgaggcctggggagcggggcctcctggggttgggggaggaggtgctcttgtaatctgcggtccccaggcgggcgccacccctccgcccgcccgtgccgggagcgcccggcccgacagcaagcgcctctggggccgataaggccctcgggggcctggcccgcacgtcacaggccccgcagaggctgcggtgagtccgccagccccagctgctcctcctcaagcccccaaggcccttcggcgggcccctgctgaaagaccggcatgccctattctgtgggcttccgcgaagtgagtactgggcggctgctcgggtggacggggagatgtcaggagggggccacccaggccgcgccagtaggcagcacgcgagcaagagcagctttgcacaccccacccgcctcgcctccccgtgggctccctgccttagcatagcggcacatcgaccttgtagctgaaggcagcaggtggactctgccctactcgctgaagccagtttcatattttttacatccagagatttgctgtcaaattgagttccaactacctgggtctctgaattatgtcctgtcagcaatagcgctggggagggatggtttttggattatagtccaaatctattgagatcttagaggctttcctttgagtctgctaaactgcgttttgtaggtgtgttattacaggctgcggggtgggccacccggctagggggctgtcactgtcatttggaaggggactttggcttgttttctcaaagactcacggaggccggtggtctcatggtcacacctgctcggttcttttaatttatgttgttaattcatggagagaaatatgtctacgaaggaagggaaagagcggcagcgtggcctggggagataggctctcatggatatttttcaagtgataatggcgcgttagcaaggccactccagccttcttgttctccctgtgtagatagaacccgtcctatctctgcctggcagcacggccagcctgtgccatgtgtcagtgtcctttgttgggtacggttcttagtttagtgatggattcagagcccagagttggacatcaggccacacacacgctgaaagggtagtaagtgaaaaggagtctggtttagtcgcgggcagggcatttcgtcttctgcttgtctaaaagtcgctgggtgcagaggaagcaatactaagcgggaatttctttttagtggcatctgtacaatttgcctttcctggttgattttttttttttttctaaggagagagaggctctgtagaggaagcttgggcctcccactttagttccaccagcggcaagcaattcaggttaagttggtagagtctttttcctcttgtggcaccactctagggcagaggttcagggtgagtcttggagacctgatcatagccaactttggaaggaggcaggtgactgcaggtgtcccgtgcaatgtgtgaactgtcttcagactcaaacgcaagtgttttgcaggaataaggaatggccgatggaaaaaatgggtaaaattagccttctttcacaaatcaagttacagcctcaagccacttttctctgtgtctcagttttcttgtctgggaaatgggtctgctgtgaggctgaagtgagttactcggttatgaaaacattagcaaaggggacagaggcttgaagacgtttattgtaaccaggatccatagactcaactcacccttgactttatgggtcaattataattagtttcttctctgttattggtatataataatttacatatttgtggaatacatgtgagtgtttgtttcatgcatagaatgtgtactgaccaagacagggtatttggggtgtccatagacttgaatgtttatcatttttacgtgttggtatcattacaagtcctctcttctggtaactttgaaatgtacacggtattgttgctattatagtatagtcaccctaagctgctatcaaacaccagaacttatttcttctatctaactgtatgtttgtacgcataaccaatctctcttcattctcttgccccccacccacccttcctggtctctggtatctattattctattctctaggtccaagaaatcaacttttttagctcctatgtatgactgagaacattcagtatttgtctttctgtgcctcgcttatttcacttagcataatgacctccagttacaaccacgttgctacaaatgacatgatttcattctttttcgtggctcaagcagctgtaattagtttttatatttatttatttaataataattattattatttttaagacagagtctcgctctgttgcccaggctggagtgcagtggtgtgatgttggctcactgcaacctctgcctcctgtattcaagcaatcctcgtgcctcagcctcctgagtagctgggactacaagtgcgtgccaccatgcttggataatttttgtatttttaagtctcagtctcaccatgttggccaggctggtctcgaactcctgacctcaggtgatccacccgcttcagcctcccaaagtgccggcattacaggcgtgagccgctgcgcctggcctataatagtttttaaacccaggttgccacctctcaccccaaaatggttctgccagtgtctctgcaaaaccagctgacttattttgagattaatcaaactgcaatatatttagaaaagcagggtttcagttgttggtgttgccaaaatgaacagagaaaataagagtgttttctaaaggtgaagtgactaaaaacctttgtcctccaggtctgtttaacaacctttacggccaggcacggtggctcacgccggtaatcccagcactttgggaggccaaggcaggtggatcatgaggtcaggagttcgaggccagcctggccaatatggtgaaaccccgcctctgttaaaaataaaaaaaattagccaggcgtggtggcgtgtgcctgtagtcccagctacttaggaggctgaggcaggagaatcgcttgaacctgggaggtggaggttgcagtaagccgagatggtgccactgcactccagcctgggtgacagagtgagactctgcctcaaaaacaaacaaacaaacaaacaaaaacctttaacaagcatttatgaagcacctattgtgtattaggtcctgttggggcaccgggaatatagcagtgaataaaactgacaaaaactctgtccttgcagagcttatttcccagcaggggaaggaaacaggctaaaaacaaaataaaggagtaaactgcattctgttgaaaggtgaaaagtcagtcctgttattgagggagagggaagcgggcaagggaaataggatgtgtggggagttctgcaactgaaatagggtactctgagacagcctcattgaggtgccattggataaagaggtgaaggaaacagccaggccaaactccagaggaaacagcacatgcaaaggtcctgaggcaggcgtgtgtcatgggaataaccgggaggccagtgtggttgaagcagagtgaggcaggaggagcaggaggaggtgaggtcagagagattgggaaaggggcacaggtgcagaagatgcagggctttgtacattgatgtggggattttacttctgccttgagcgagatgagaagcattagatagtatttgtatgaggcaaatggcaccatctgacttctgcctatacctatgacttcctaatgcctttgaaaccagggattcacgttttgtagggatgggctaccaaattaaaccacctgatatagtgtggcaaatggtgttatcatgcaattgtagtacaaccgttctcaacttgcttccctctgggatacatagggctggttgttgacatagttctgcatgacatatttcatggctatacctgggtattaataatccccctctctcttacacgttcctatttaatgagaaaatagtgccatagatgctccctacttaataatttaccactggttatatttaaaaggagatgggagccactataaaatcacaattcatatgtagtatatgaatttgcaatcacagctgcagaagatccttcatggtcttcttgggaccttggcatggataaagcggaacaaggttctggagcatgagctgtcaagaaagctcgggtgtaagtgtgcaagagcagagctgtgatagaggggaaccttgaatgtgttctaagttttaaaaagcaacagtggtcttcttacaggtggtctcactccctctaatccattcttcacacacaaccaaagtgctgttttagaagggcaaatcttaccacttcactttcttgctttaaatcttcagtggcttcacagtgttcttaggacagtgtagactccttcctgagatgcctcctgtcctgatcctgcactgttgtatttatttttttttattgtttgtttgtttgagacagggtctcactgtattgcccaggctggagtgcagtggcacaagcatagctcactgcagcctccaactcctgggctcaagtgatcctccttcctcagcctccagattagctgggactgcaggtgtgtgcacctccacgttcagctaatttttgtattttttgtagagacaggggtctcactatgttgcccaggctagtcttgaactcctggcctccagtgagcttccctccttggcctctcaaagcacagggtttacaggcatgagccaccgcactcggccctggactacttcttattcagaactcccacaataattgctccaggacactgtcagttccttcaacaggctgcacttggacatttttatataatattcagaaactctacatgggtgggactcaggcttgccttgttcactgctgtgtccttggcacttagcacagtgcctgccacatggtagatgctcattaaatgttggttgcattcatgaatgaacagtaaattatttgcagaacacctcgtggttgatgactgcttagcagtttgctcacaaacctgcgattgaaaattattgctctagggtttgcgtggatgactttttagatactctgctcttgggattttttaaaattcataaaatagtttctccttcctctgaactctcattgcacttcatcagaacctccctcagggccctcctcattttccacacctccccgcttatttatatatatgtcatctctcctccacgctgtgagcgggcgggaggcgggcaacagctccatctgactcatctttgagtcacttcctcttattttccctggcttcgaccaaggtcttgaacctggggctgaaaaatagatttgttaagtgaattaattggaaacccatgaatgagtctgagctcctgcttctccttcgcttgcccagatcgtgagctttggctgttaggaaaatgttgggccaattgatgtcgggaaggtctggaaaataaatttgcaagctggccccgtgcgggagtaggtggttacagcctgacacccctgccggacgaggtttctcagcacagcccagcctggactgcagccctctcagggcaagtgtggcgtttgtcatcattctccgacaggcagtgacaaccaattagaaatctagtgagaagtggcattgttttccctgctgcctcccgctcacccttgactgtcaccctcccctcggctgctgctctctgagcagaggctgatttatctcctgaatttactgtgggggctcaggaagaaaagcgcattacaggaggaaggctgactgctgctaatgggcccggctgagcagctgctgaaacctattagcgtgtaggggaaggtggcgcaggaatgagacagggtgtgttgcctgtgcagaaaacttgtttatagacagattaggaaaaacaaagcaagcaaacaaccttctgccccccagcccttctctcctataggaacgcctggaagggttttccttcctgagaaagctctgggccccccatggtgtctggaaggcagcggggagcctctgtggccctcccccagggtgttattggtcagaacactgttctgccctttccagatatgggaaatgaagcaatattttggaagaaagggcacctggtttcagttttcttcagaaagttagtgcctccccactttgggagtccgaggtgggcggatcacgaggtcaagagatcaagaccctcctggtcaacgtggtgaaaccccatccctgcctaaaaatacaaaaatcagctgggcatggtggcgtgcgcctgtagtcccagctactcaggaggctgaggcaggagcatcacttgaacctgggaggcagaggttgcagtgagcagagctgcactctagcctggagacagagcaagtctccgttcaaaaaaaaaaaaagaaagaaagagagagagaaagttagtgcctgccaatggatcacctgaggttaggagcttgagaccagcctggccaacatggcaaaaccccatctctaaaaatacaaaaattagccaggcatggtggtaggcgcctgtaatcccagctactcgggaggctgaggcaggagaatcacttgaacccaggaggcggaggttgcagtgagctgagagtgagatgccatctcaaaaaaaaaaaaaaaaaaaaaaaaaaacaaagttagtactgagaaaagctgaaaagaggctggcacaggtccagcccttctccacacctaggggcgcagccattgatggagggtgatgatgatttgcaaacagtggagcagattccagctactcagaaaacctattagcggcttgtgcagccacctggtgccctctgtcctgctgtcagcccactctggcaacctctcctctgggtgggggagctgggctgggccagggtgtgtacctgtagtttgctttttctccaaagggagtcaatggctagaggaccctcatctcccatctgtctaacctctaacatgtctaagtcccgcttgggactggctaatgttctgtctacacggcgtgatttgaagatgccagaatgtcttcgtagtctttgaatacctcccccaacccccattagccagaaagtctaaagttccgccatcagagattattccttaaattcttaaaggggttttatatctcaaagtcttctattaattgcatgcatttaaagctgtataataggatctcgagttgtacagatgcagggaactagttcttagtgggattagttgaggattaggcaaacgccaggagtgagattcagggcaggtcatgaattggtggggtgggggtgggaggtgcagaggtgttggtgcagtggttaggagggaaggggaagctcgctccctgagctccctgagctccctgacttaggatagtgactgggctcaagattccttcccaggccgggtgtggtggctgatgcctgtaatcccagcactttgggaggctgagctgagcggatcacctgagggcaggagttcgagaccagcatggccaacatggtgaaaccacgtctttactaaaaatacaaaaattcgctgggcatggtagtgggtgcctgtaatctcagctacttggaaggctgaggcgggagaatcgcttgaacccaggaggcagaggttgcagtgagccgagatcgcaccattgcactccagcctgggcgacaagagtgaaactctgtctctgaaaaaaaaaaaaaaaaagattcctttccaagtggtcagataccctaggacagtctggcctgtcacagcatggagagtgcagtttggtgagtgatgtgggacttacagtggacctggaggcgggtgacaggaactgcccagattctgaacaccctcttcacaaacgtgtcatccaggtggcgacaggttcagcccaggaattggctggactgtgtggcctgaggtccccggggttttatcccttgcctttctaccagcttttcaaaccttgtgtgtggaattatatcattttaccatacaagaagcacagcactttctttatatatttcatcttaacgtggtattgaaactatcttgggatgtaggtgacagtgtcctcgctttctagatgaggaaacagggttgaacagttaattgattggcctatgtttcccagcgaggttcccagctcacgtctgtctcctaactctctaatatagacactcttcaccatactggtcgtgctgaaactgttatttagatgcctgtctccccactagtcttcagtcccaatgtccagattgcctggtgcaggtgaactcgtccacacagggccttgaggctggcagtgtgaccgcaggggcccagcagcacagcacatggtccagcttgtgggcaccgcagccagagtgcctgacctccaacctgtgctctgctgctttctggactttatcctccatcagatatgtgccctccccgcatctccagtccgcacctggaaaccaaagaccatcgtggttgccctggggttgctgtgagcaacacaggaaatcagagccagccttttgggaaaagtcggtgattataaacttttttgaaatcacaggttcttctctggatcaataactcttaaccttctaagaactctggaaatttaaagaagatcttcctacctttaacgtacctttgactcaggccaacagaaagtatggaataggaaacagtaaatcacacagtctcttgttctcaggaagtgggaaatgctgcattcgaacaataccatggaggctgaaacagggaagagtgaacgctctggccaggaaagcaagagagtgtgccagggaagctttgcagaggaagagaactttgaatgggccttgaagaatctgtagaatttcacaaaacagagaaagcctcatgaaaagtgtggcttgtgtgtttgggagaggtgtaggatccagtgttgagggacaggtggggtggacagagtaggagatgaggatgaagagatagagaggagctggtttgaggagccttctgaacgtcagcctgagactttggtctttagtccacaggggttggggaagcccacaaagctttctgagtaggaaagtgttagggcttcagaaagcccccatctggcagggctgatgaagaggggtcactggagtgaaaatattgcccctctaccagtaaggtttgatgaggtcctaaatcgaggggattggaagatcatgaacattcttgagtagcgactttgtacccgccaccatgctacgtgattaaatatcgcagcatatttaatgcttacagtggccacataaaaattacccatgttacagatgaggaaactgagattgcagctaggaagagtgatgaaataaagttgtttattggggatattgactggctggtcgtgtaggtgcccttgtggtctgagatgtagttctggtaacttgattttgagacacaaccagaggatagcaggtttggaaactgacttaatgcacctcacaggtgtctggtgttcacgtcagtactccgacttcacaatgagaaatctgactcctccggtcctctgccattctgtgttcttgttcacttgtgttctccggtcagtgaattctgtcctaataagaaaacctaaaaggcaagtcagtcacaaccaatgtcctggtaagggcgcaatcagagaaacaggaggcgacatcatcttgaatctgtcatcgagactgtgctatggcctgatgaatcatgcacgccccatagccaagagcactgtgtttgttacaaattgctgattaaacaacattggaatagaaaatgagtctcactgcctggtgtcaacgccaatccaattgatagcagctgtctgggatgctgtgttgagagattctgaagccactttaaggcttatgggcaagagtgctgtgataacttagcaacctctgccaggggtactggggggcagggtggtgtattatggtagccatttctaggtcactggtgtttttccttctttctcctcctcctcctccccctcctcttctccttccttccttcctgcctgcctgccttctttcttcttccttttgagacagggtcttactgtgtcacccaggctggagtgctgtggtcatggcccactgcagcctccacctcctgggctcaagttatcctcctacctcagctgggactacaggtgcaggccagcacgcctggctatttttttcttctttctgtctccttctttagtttagccttaatcagatgagccatgttttgactgctatttacttaagagacatcctgtttttcaaggatgtttgaagctagctggggctatgcctctgtgttgattgcactggtttacctctcagaaggtcatatgataccacacgttttccagttccttatctctcccagctacccctgtcaggttgggctgggggttggggggtgggtcaccattaaatataggtcagagagccagtaagtggcagggtctgacctaggactgtgtgaattctaagcccagctctttctactacacagaagccgtaggtaggggaggcttttcattaccaaatgggtgtgaattgccatttaatatcaccagccagaatggacttttcccacattttttatataatcacccacaaagcatgactgctcgtctccactggcctccagcccctccaccactgtttccctgcccctgtccaagcccagcccacccctctgggccaggccagggcctgccctccagtccagcttcccagctcctcaccctctggtccccttaaggccatggcccccatcaggcatccctctgtgctttgggacgtctctggcactaaataaatacatgtggagtggaaaaatgaatgaccactggacacccactctgacttcagtgtgtgggaaaccatgaaaacatgtcaaccttgctgtgttgagtgattcgttgaagggaacttgttccatcactgcctttgttcttttctctttatggaatctgccatagaaacagcctttcattagaaccactgtgtttctcagatttggttaaaaagcatctgtaggatgaactggcaaatcgggaggcttgaatttccaggctccatcgagatagttttcctgcggagttttgaaaattcacttgttttcagtgtcctcatgcctgcatctgagaaacagagacactagtgtgtggcaccgaccaccacaaaggggcctggtggtgagtgctgggctgggattagcaaattgctccgaatgtctcaggcacaaagtggtacttaaatagccattccaggattaggataactgttctgagcccttctctcgactccattagtttgcaacgtggccactgggggcttgtccctagcctttgaataaatgggatggcttcagagccagcagtggctggggcagcctgaaggtgttgttgaaagatctttgctttacttgtttgcatctaattttgtttatttctttaccaataaagatgctttctcctcaggggcattatgactgtgacctgggtggagcctgtctacagggtccccaaggttctctcagggctcaggggcaacacccagggctgcctgtagacgcccctccagccctgactcctacagggagcccccctctgagatgttcctaattcctagcccctggcaagacgcgagctcctcctcttctttcagagtctgtggtggctgctctgaaaagcatttaagagcctggaaggggagatgggctgtgcctcgaccacaaaccgcgccaaaaggaacctgctacaagatacaatgctttggaaactcgggaggaggagagaaaactgcatcggagggaatcaagggacgatctgcagggaggtgcctttaagttggctgtaaggggcactccagagtacagggagaagagacgcgggagggttcccaggcggagagtaccgctgatgacaacgctgcccgacagtgcggaaagcatgaggtcagctcggaccctcggctaccaagtggacccagaagggccgagcaaggctccgccagggtgtttaaagggtctggaaagcaccgaggagcaatggacggctctgagcgggaggacccttgcagtgagtgatctggaaaggaaggaagcctggagaccgcaagatcaattcggcaactcctgcgggaaggcccaggcccggaagtgatggagaccctcagggatgcgcagcgagcaggggcagcagtggttgggactggagtgaccacacccacaagaggggaaggtcggaccccagccaggcctcatctaagaaccatgcaggcaggagcgcatttcatccccatagttatcccgtgaggtcactacaggctacagataaggacactgaggcacagagagattgatttactcacctctccgtagctagacagctgcggactagggcaggaagccaggcaagctggccctagactcagagtccttaatcacaaactcattctgcttcatgtgtttttattatctaattaattgcttttagagacagggtcttgctctgtcacccaggctggagtggagtggtgtgttcatagctcactgtaaccttgaactcctgggctgaagccatcctcctgcctcagccttccgagtagccaggaccatagtcatgcaccacacccctggctaattttttaaaaattttttgtagagaagaggtcttgatgtgttgcccaggctggtcttgaactcctggactcaagtgatcctcctgcctcagcctgccaaagtgctgggattacaggagtgagccatcatgcccagtctcattctgctttcatctgaggggcagaaacaggagactcaagaggagaagccggggctcgagggctggcaaagcccagcgtcgctcttccaggtcctgtgcagcatttcagatggaacccttggaagcccactgaccacatgtgtgacctggggaaggcccatcttttggaaactttgtatcacctgctttgcccattccttcaagaaacgctgatttgttgaaggaacataatttgttccactatgtacagggctttcttctgaacttagaaaaccaaaaacaaaaccacctcaaaaactgtgcatgcatcaagattcaaagcccagatgcattgcaggatgtttgtttaatttgcaaaaccttcaccatgaggtttctttcagtaattagctcccaagtgcatatgaaaaatattatagataaaaacgtttgtggaaggcaaaaaaaagctttaactgaatagatttagttatacatgcatgataaaaagtgtccaaaatgtttctagttttctccttgcctttcatatttgtcagtgaatttaatgacaaacatcaattacctgaaaaatgtccttgcggtaggtggtagcattgaattgtattacagatcttattgaaggggtgaatacttaatatactaacgttcacatttacaaagccagaaaattagggaattgattaattctatcccaaaaggatgctttgctttaagaaggaattcactaaatactgagagctattgcattaaagttctttgttttgatggtgttagttcctgggcaccaggaggctaggagtggagaatggggtagagagagtgggggtgagagagtggggtagagaaatatagtgaagtgttcaaagctcggtcagagtgaaaataaccatcctttccctaagtgtgttatgtgggggaaataaagagttttagagtcaaatgcgattatggaatcttggcttaaacactgttaatcagtttctccaagaatgctcacagctttttttttttttttgagatagggtcttgcgatgccaccaagtctgcctaggctggagtgcagtgatgcaatcatagcccactgcagccgcgacctcctgggctcaagtgattctcctgtagctgggactataggtgcatgccaccatgcacagctcattaaaaacaatatttttagagatggagtcttgctatgttacccagtctggtggcaaactcctggcctcaaatgatcctcccactttggcctcccaaagtgctggaattacaggtgtgagccaccatacctggccctgctcagggctgtaatatgcttccttggtttgtgactctgtaaggacaaggtttgcattgtccacatttacttgcccagagcaccctttggattggtgtgggtgacattgcacagggctggtgttcctgggaacacattttgggaagtgcagtgtcagtctccattaagaggatggcgttcagattttcctttgttggagagaccttgatcattggatggacataggcaggggttcaatgaggaaaagggtctttctgcatgcctgggagaaactttggaggaacagaggaaaagagaatactgaaaaggctgaaaaaaagtcccgaattgtcaccaggttgctaccagcaagagtagagattcactccttggtgctccagggaaggacccaggaaagggtggggtagaagtcacaggaaagcagatttcaacttgagatgagaaagaactttccaaaaattagaattctccaaagagggaagtatttgatcagagtcttgtggataatttgggaggagggacagttgcatggaccgggagtaggacttgggagactttcgaaacgatctccttcaatgactggattaccagttagacaactctcagaggaaataggacttggttcacagaaaccccatgcgctgcattcacttaattaggtgcactactactttgctaagaactgacttatccaaatgtcgtctaatttcttcctcctcctgggcctgcggagctttgatagtttgcttggctggtttaacagctctctgtggaaatgagaaaatcattcaatcagatgaaatggatttgggatgagcaaaggagctttttttcagtgtggatattttagaaacgcctataccatttagattacagtagttagaaatcttgggactttctgatcagccagcatctaatgatcaagttaatgaaatacttgaaatttgataagctgaacaggatggaattttttcatctaatttcggatccagatttacaccttgcttacttagtttcgcataggtgattagagaggctctaactccaaatgcataagatgaagtaaacattaatgtatgcaatgtgatatattttgattcaaataaaatgcttagaattcaattcagcgagaatctgagaccccctgagacagttctcaacaggcggccccatcctttctgggtgtcaggaattacctgggggcacggagggctctacaatgtttaggggaagacctgctggatgcagggctcactcagtccgtacgctgctccctctgggaaataagatcttattttggggaggaaactggggagtggaatggttcagtggcttgctgcttagtggcaaataggtaaaaggagacgcagagggtgacattaagggacctgcaggagagcagctttactctccctgtttgaaatacccacccaagaaatgccaggcaaagcctcccccaacacggtgggctcctttgcagcaaacctctgcgttttcttcttggccatgcattttggccttgtgagtttgcatgtttggtttgaaagctctctatggaaatattcagttatttttccatctggtggccccatggcagggggtgtggcagcaggaacccttgctaaagggccccgggcccaagtgagatggagctggtgtcaggcacataagaaatgtttcctctagatggagggctctgcacattgtcacaaacccctgttttgtgcctagcctttaaaaatcccagttatttaaatccctgggtttacttagctccattcccagtttggccaggggtgtttcttggcgctctgtccctgactgtgacatagacccttagctgtgaggcagcaggggagccgccagcagcagggacccccagccctcacgcagggtgctctccaccctctcctagtaccagcccctgggatggaccctgaagctgacctgtgcccccagccctcttggccttggagaccctctgcctccctcctggccctgggtcaccgccctgagtcgggggtctgttggttgctggtctctgtgccctcagctccgtcccttcccatgaagggcagggaggagccatctgtgcagactccagtggggtgactgtggaatggtccgtcccaggccacaggggatgtgctctctggtgccacctctgccatgcctcctgctcttgctgggatggggactgaggcatgcttattcctctgcagaagacaacagcagtgtgtgtagatggctgcagaagggagggcagggtggtgaaaatacagtgagagggcctgggaaggtggtccctgggtgtggtacccacacagcaggcaccgtgcacagctgtgctggggcgagaacagattctcgtgaattctgcctaaaaggcgtctctcggaattgcctggcatggtagcccttccagttggggaatggctgctcagcagggagtcctggctgttgggcttgtgtgtggtccagagcttgccacgttttagagaaactgcagagggccaggagattgaggtggctggagaggctttggggtgcatgggccacagatggaacccactccacatcaccagcaagacctcctgttggctttcagctcttctctccagccttccaaatgtagtccccagtgaaagcagaaagtggtgactgttttccagagagggagactttccacaaatgtagaagaaccaggcagagacgtttctctttagcacttctggttgaggattttacaagttttctagtgagatgagattagaaattaaatgccagaaccactcttgatttctttttgtagtatattctctccccacccccagctgcatcctccttgtcatcctctcccccaaccctgtccccagccccagaaactaaccccctgggacccactcttggtttctttgtctgaagttgccttgatatgtgcacacacacatctatgcatgcatgcacagatacatacacacacacgagaacatatatacacaaatacaaactcatacatgcacacactcgtgcacatgcatacacatgcacgcatgcacacacagacacacgtgcacacacaggcatgcacacatgtgtacacatgttccctccgggtggcccatggaacacatgttcccttggcggccagcgctgccgaggcctcagactccaggaacaccctgaccctcagtgtctgagacacattggcccatttaggaaggaagaatctactgagggagaagcgtcccctcccctctgcacccgctgggtgggcagaggaggacgtctcaccccccagagaagaggagaataagctgaaggctctctggtgagtcactcaggttaactcaacaaactcctatgggcatttgaaaaatgttaatgctattcatgaattcaactggagtctaagaggaaataatggaaagttattggtcaaaaatcaagaagaggctgggtgcagtgtcttgtgccagtaatcctagctcgttgggtggctgaggtggtcggattgcttgaacccagactgggcaacatagcaagaccccatctctaaaaaaaattctaaaagaagtgaacccaggccaactgtctggtctgattggccagttgcatcccaggccagttcctagggaggccctgggaggactatgtcagctgtcactgacttcagcatccttccattggcctcagcacagggtaggcacttggcaaatgcaaaatactaattagagttagtggcctgaacaaggggctaccgtgctctgtagcaaaagctgtcggtggagaaccaagaacctccctaggctctgtctcatggctttcccagccagatcccatgtctctcttaaccattacttcctcagaatttctgagcttcttgttgctgcacaggcgtctttgaggcacaaaagcagaatgcttgcggtggccgacttggctccggttgctgagttcaaatcctaactccgccacttctctgctatgtgaccttgggcaagttttttaacctctctgtgccctgttttccacttgtaaaataaggataagtagaacacctgacttataaagttgctgtgagggttaagtgggtgaacacttgtaaaatgcttagagcagtgcccagcacctcctaaaatgctattgattcctgtcttttctttttttcttttgttcctccaccagtgcctctaactgcttgtcccatgggcatcaaactagaggctgagcacagtggctcatgcctgtaatcccagcagtttgggagcccaaggcaagaagatcacttgaggccaggagtttgagaccatcctaggcaacatagtgagatcctcatttcaataaaaaaaaaatgaaaaacattagctaggtgtggtggtgctcacctgtagtcccagctgcttgggaggctgaggtggaaggccctcttgagcccaggagttcgaggctgcagtgagctatgattgtgccactggactccagcctgggcaacagagtgagagaaagggaaaaaaaagttgtctagcatctgtaggtgtagagaagggcattccagaccaagcaaggggcatgtctcagggataggagagggatgggttggggcactagagtggtctcccactgcatggagcttacctgtcacagcctgggcatgtccaggtgctgctgccttatccctgcctgcatccagctccccaagtgtcacctcctcataaaggcctccgggactgaacaccatcgggtactgcaccccacagccctctccatccccactccacgtttgattttcctcttagcactcaccacttccctgtgggataaatagatcttactgctcctctatctctctctcctccctcccataggaatgtcagctctatgagcgcgggattcctgcctgtgtgttcagtgtcggatcctaaacaaggcctgacccctccacaggcacacacataatttttaaatgactgaataaatctaaaaatcatcactttattttcctctttgtataaaatctttgtgagggatggaaactccctccaacctcacaacgggagacatttaatgctgtaaaggctatacgatcgttagcaacgaatcattcctttacataacattcacacagcttcctacaatagacgtatttatgttgttgtctaacatacatgttttaattttcaagcgtttggttctggatccacacgttctctccaggaggtcaggaagcctgtgttctctgattatcttttataatcaagaagattctggaacacagcggcctttgaaaaagcattggtggtattgaaatggatccccacaacttcctaaaacctggcagtctttgaagattctgttcaattctcactgctccatcaaagatgcccccagtgctgtagccctctctgatctcagccactcccttgaactcctggtggttcttgttgcaacctctcgtttggtatttaattgcacactgtcttggggcatctcttgagctattatcttactgagtatttgacccttttattgtcctatttttcatacagctctatctttcacctctgttagtttgcagtcttcccaagagtaggaaccaaacagcctttactttttttgtgtctaccactgggtgctgagattgtacaatgcaattcaacagttcacatttgagtgaaagaataaatgaatgaggaaaaagcctatctatctagtcccaccgaatttttgcattgagactttatctctgtgaccctcacccgaaaagcacttgaggcagtagaggcgggtgtggatattggtaatgattgtccttaggaaatgttgattggcatcttggtatcttatttcagaaatcctggaaatgtctctctccgaaggctaaaactcagtcattccagaaatgatgcgctggctgtttttgtttgatactagattcactgtgcatttttcattctttctctaatgcttgacatccctttattcaggagttcaaggtcacgagtgctgagacaggtcactttgaaaaggagattatgaaagtggacttcagcactgatgttagagtagaaatgaggtcttcacttcacgaattcatggaactgcagagctggaaagaaagttgccaacacaaccataacattgtttgtttgtttgtttgtttgtttttatttattgttgttttgttttgtttttttgagacggagtcttgctgtgttgcccagggcccaggctggagtgcagtgccgtgatctcagctcactacagcctctgcctcctgggttccagtgattttcttgcctcagcctcctgggtaggtgggattataggtgcacgccaccacgcctggctaatttttgtatttttagtagagatggggtttcaccatgttggccaggctggtctcgaactcctgacctcaggtgatccacctgcctcagcctcccaaagtgctgggattacaggtgtgagccactgcacccagccatatttctttaaaaagacatgaagccaaggctttaagagggggccccctagacacccttcaatattgtgcagataagaaatacccagattagagacataccttaggattcccctgggatgggcagagttttctgcagataagcaacgtagaaagaaatgcagctgagggttgacagtttagagcttatttcctcaccttttaaatttaaatagttacaaaaagggtgatataaatactgtatgaaaagatatctgaaagagcagccagccagaattcataagaggattaaacagaaagaaaatggttcccttcaattattaaaataatacgatgagccctgtgtgaagtattatgtgtgacacctgctcttgtttccttggtagtaaagagaaaacaggactaggaagtcgagggctgacgccaaggtgttttcgagtggtagctgctaagcaccccgttgaaaggagcttaagtgcatcttggaggaaggatcctgtcttcctgttgttaagttgtacaaatggaaaaattaaagaggcataggtaggccagttagtagtttaattgggtttaattgcaatgttttggctctgggaagagagaggaaacctctgcagtcagcatttagccagtggaagccaccccttatcagcagggccccaatgaaggcgaagaagtgggtttcacagcagagggtcccctgggcttggtctacctcattatcctttcttggagtctaggatcattgtgggccagccgggaagacgtagcaccagctccctggagcttctttctcttggttcagaagtgtgcaatggaggttacatgacgatgttactgttgtaattctagagaactcgattggagtggactgggattattgattcaaggcctccccatttctccatggctcttggaaaggacagatccccgctcattaaaccctggagggcctagttcatggaaacagatacctcacatttctgcattgaatgtgatagtgattggtggctggcattttttctgaatagagagaatggccacattattaaagatgccccggttgcacctaaatttccaagactgagcaactcttactggagaatattgaatttcagttttcccctctaccctaaaaataccttaggttgcagaatggtgcaaagcccagggccagcccctttactgtgtttcatgcaccaccccaggcatcaggcatcatgttactcctggaggactttggacaaatgacttaatgtttttgtgccttagctgcttctgtcaaatgggaataataatagctgttaactcgtagggtggttttgagggttaaatgtgttaacatctaacatgctttgaacaatacctggctcacacattgtagctattattattgttattattagaaataaggtctcactcttttgcccaggctagagtgccatggcaggatcatagctcactgcagccttgaacttctggcctcaagcgattctcccacctcagcctcccgggtagctgggactacaggtgcgcaccaccatgtatggctaattttaattttttgtgtgtatggagaaacagagatcttgctatgttgcccaggctggtctcaaattcctggcctcaagtgatattcttgcctcaacctcccaaagtgctgggattacaggcataagccaccatgccctgctaactgtagctttattattattatcttcaaatcagttcccccttcctgctctcacttctgtatctcattgtctctgcggtgaatcatcatgggctagagggtgtggacggggccttccaggcctagttcccaatggatggttcaaggctaccttctccatgtaagggaagccttgctccagaggctggacaaactccaggggcacagaccccaaatttcagggtcacaagcccctctggaatcttgggcaggtctctctggctggcaatgggccacccatcctggctctgtcccttggggcaaattgttcaaataaaggaggagtctcagggtaccccctggtcggccccgcctgctccagatggcagctcatatcaggcaaagttgcatttctaaggaagggtgggaatctttcttcattgctgaggaagagcgtgccatgcagggctgtccaacgcctgggcatccttcagaaactctggagccatggggttcactgccagtacttaagcctgtttggcaacttgaaaaaaaaaagaagagtccctattttccctattagcaccttcccaatgattttgattttgcattttctccagtatgtgctcctcctcctcgcataccagcaggctgcagaggaaggtttccctaatgtttggaaacactggaggtagtttagtaaatgggcccattctggcagtgccgctcatccacattttccaaaatgtgtgtaattccactctagtctcggctccccagtccacaatatgttctgaagtgtcaattctaaatgcagcccattccttgcgcagtggggaaatgtggcatgctctgcggcgtgggccagggtgcttggtgatgcgggtgcacttggaattctatttaggcacccacaagacaccccaatatcttcccaccctcagcagaaagatgtgaactattgaagagctgtctgcttcgctgccttgggactgaggaaacaattgctctcttgggcttggactggcaatttaggactaatggagattgtggggaaaggatgggcagggcaggttggggtgtggaggcttttttctgcagcacggccctggccctgggatgggaagcacctgaaacttccctgcccagaagaggacagtggtccccaggctgtttctacaggggctataatagcacgtggggacattgacaatttagtcaactagccccgaacatctgattcatttagaaatctgagttgactggattccaatccagctaacgtttatggagcctctgttgtgtggccagcattgtgcttaaactcatgtctgttgttttcagcatgactggtgggagctcctacctggttgacatggggcacaaaactgcatcatgttctgctcaggaaacatgtattgagtggtgcttctgtgctaggcttggggattctgagttgagcggagatgagaagagacctcgtctcctacttccctgcccagggggtcctgggtggtcccagaactattcagcagaagcatttgcttaatctcaaggcattttgttctttaggaattctggttctatttcttatccaaaaagagacacagatactgaagctgaaatttgttattgtacataaaacattctgttcgcttcatctggttatttgatgggaaacagtggcgtttggatgcctgtttatttctcactattgggaaaataatcctgtcccccgcaggcttgccacttgggtccactccccatccttctccagcaccgggactgggtttctggggagctgggcaccgtggccgtggggaacttagactttccttggatcttcctgttgtagattctcggctgtgggctctgcagtgcatgcaggagggagcgggggttccagaacatgtgatttgaaagtaggaagaagggggagatgccggatatatcaaaagcacatggagttttcacactgggggtagagggatttaaaaaaatctcaattctgaaaaatagacccggtgtgcaaaaccctttccaactcacgagctcgttaggagtcgaattccaccaaagccatgccaaagagtgggcctgtaacccaagagatccctttggaaggacagtcaatatctgatcccaggaataaggggaacccctgtgtgtgtgaagagaaaatcctaggttcagctgtgcctccccccttccctccctcctccagggatctcgggtttaatgttggccctttttggaatccacacagcacctttctcatgggtttaaaaatagactccagggctgccaaccctcttaaaaagaacatgatggagattggtgccaactctgtggggcctgatccgggctctgatcacctccctaaatagacccccgcacttgccatcccttactccagccaggccgggtgcccaggacaccttaattgaccactgggcactccctacacaaagttaaatagaaaaacaaccaagactccattcctctctccctttcttctgtcactgccattaaggttaagaaggaatgaccaggtttagggggggtcaggctggatttctgattgaattcaatgtgacatttgtgtggaacattctgtaaagttccttcctagttaataacatttccccaacagcgatgctcctggtggctgacacactccccagggtggtcgctggctgggtctgagtggcgataaaccagcctgcctttctcggtaaagggtggagttcctggtacccacccttatcagtggtgcccagagtctctaggagcaggggcggctccttgggtgggtgaggatggaacagatggaaggagggtcaggaggagagcccaacgggtcagctggccacagccagcagcaggacactgcaagggcagctgcggacagggagcgtgggggcacaactgagtccacacattgtttctttgctgcagagaatatgggcattgaaaagggtgcattgtaagcccaagaggtctgggtgcagggtagagctttgagatttcttgggatcctgatcttgaccatgggtgtttgaccctgggtaagcagtgatgaggccttgattttccagtgttgaagcaagatcagtgacaacccacacctctgggggagacattaacctttgacaaaagctttagtcgagaagaaatggaggggaggaggaaaaaagagcatcagctgtcattgatagagcacttaccaaatgtgccagaagtggtggtcagcattttacattattctcccaatattggagagatgggtgaagctattttcactttactgatgaagaaatcaatgctcagaaaagtcatttcctttatcaaaagctgcacagctcaattgtgggagacctactgatttagagcctcttaagaggctgtccagaaagcaaatagtgttgttgctattgagttctgggtttgagttgattgcataagagggttaagcgcgacggtcattgccacagggcctgagctgccaggatgcccttctctcgaatcctggggctgccctgatctcagctctgatgtccctgtagagaggagccacttcatgtctctgactggccaccatttgaagcagcccggacctgttctcccaaatcatcctggggaggcagagtcgcctgagaatcccactcgcatgggattctttgctgcaggcttgtgttcttccagctcgtgaaatccctgcaggaattgacagcagcagcagcccatcaagtgtcccagagtccctgtctatactgagaacagcccactgcatcaagccaggagtgagctgggggtttaagtgctgcatagtctatttcttccctttcttctctcccacatcatccctgcttggcatagctgcatgtggcccagaggacagaaccccacaggcgaggcctccagcttttcattatgcttgtctgcagagagacctgcaaggagacagtaggtaaaatatttagcaagacgggaaaagcctgaagactccatgaagctacaggctagaacagtggcctgtgtctgccgagagtctttagccttttcttcagcccatcaattcctttctggtggtttgttttgatctcactagcaagttcttagcacactaaatgcctacattaaaacgtgcagccttgaagtatgaacaaaatgcagatggagaagcaggatgattatttgtggtctaagggtgtggttgtgatggaaggttgaggggacagtcagttatggggaaaagaacaatagtttagctttctgaatccctagggcccaaagagacccttccaagtcgtacagcttacccagtggtctatatgccagatcaaatgttgaggttttttttttctgccatcctgaaggatctcctgcaaagattaaaccctttctgaataaagagttctattaagtcacgtatctcttatagctggaaagttctttctgtggaatctaaatcttttccatagcaactgaaccccaagacttacagtttctttatgactcatggaagtgttggggacatcattcttctaacaccagtcagtaatcactgtgtttagcactgcccggcactgtgccagtcacatagaggagtaggtggggaaagcaagggagagggactgggaatttggaacatgagaaccaagctgtctctgcctgggagacatttagaattcagtcctggtggcaggccaccacacctgggactgggcaccatataattagctccaatgtggcattccaggctgcagtgctggaatttatgtttcaagggctctctcccttagctttatcatctcagctcctttagcctcaggcctcactgagcaacatgtttgtagttgtgttctttctcctcctcttgggccttgcctgactcatcgcctgcctaagtttttcaaagcctcaaccctaaggaggtcatgactaatgtcaagaattcttggcagttctgagaactaaagtcctctgataatacttcagcatctttcccattacactcagagtgctgtgggttgtattcagcttctggtccactatgactatcacatcttttaatttgtgattgtatataacccacagcgttgtataatatgaagaaagatacagcttaagaattataagaaccgagtaccaaaatgcgactgggaatgttttgctactgagctttgaatattttacttgtaagatctgtttatctcacctttaagacagatattctgtatagatagaactctcaaaactcaataagaaaacaaacattccaacttaaaaatggacaaaagatttgaacagatgtatcaccaaagaagatatataagctgggcgcagtggctcacgcccgtaatcccaacaacatgggaggccgaggcgggcagagcacctgaggtcaggagttcaagaccagcctgaccaacatggagaaatcccatctctactaaaaaaatacaaaattagctgggcatgttggcgcatgcctgtaatcccagctactcaggagtctgaggcaggagaatcgcttgaacctgggaggcgggggttgcagtgagccaagatcatgccattgcactccagcctgggcaacaagagctaaactcttcctcaaaaaaaaaaaaaaaaaaagaaaaaaaaaaaaaagaagatatatagatggcagataagcacctgaaaaaggtgtttaatattatcagttattggggaaatgcaacagaccccttctctacaaaaaattttttttaattagccatgtggtgcatctattaggatgtctgaattaagacagatcataccaagtcttgacaaggatgtggactggccggcaggaggcagggaataccaagaggcatgaggaaacttttggaggtgattatgcccattatcttatgtggccatggtttcagggatatacatatgccaaaacttagcaaattgtacattttaaatgtgcaactcgtagtgtgtcaattaatcctcaaatagttgctaaaaaatagtatctctttcagttcattgtgcaagtcaattgcattcgtgtttttaaaagtattatatatattatttactcatctgagcggggaattttctctctctctctctaaatattaatgttggaacagtgcattagaatcccttgagatattccactgggctgtgatcaggggtgttccagtaaccatcatttattaattggagttctctgtgtagaggattctagcaaatctggaaggtggttttcagaggtacaaggcgagagacctggagggtgagctgggctttagcagcatgtgcctggggagggaaggggctgtgtgacttacatccagacaggctgctgccttcgagagggtgcccatcctcaagttcagccccagtgctgtggaggatcttatgcctggagaattctcacattgtcatcttcaaataccagttttttaacccccatggggaggagttgtattattacatttcagatccctctttttggcaacaccctggccttttctcttgatctttgattatcccacttccttgggatgccccgattgctgcatagctttgaagcgtacctggctttgtaacacactctcacagtattttcttcttttttaatttttatttttttagagacagggtctcactcttgtcacctgggctggagcgcagtgttgcaatcatagctcactgcagcctccaactcctgggctcaggtgatcctcctgtcacagcctcctgagtagccaggactacaggcatgtgccaccttgcctggctaattaattttttttttttttttgtggagacagggggtctcactatgttgcccaagctggtcttgaactcctggcctcaagcaatccccccgcctcagcctcccaaaatgctgggattatgatccttcaagatcatcccccacattatctcttcctggcgctgagtacactattgttaggaatcttgctggtgcggccagtggcagggctttggatcaatttggcttagaaccagttggacccaccatttactagtggtgaccttggtctccacccattacctccctgggctcagtttcttcatttatccaactgtagtagtgttgcctaccttatgggtggctgtgaggattaaatgagataatgcagtatgtccatcagctaataggcgctcagcgtgctagttcctcaccaacgcgcagctgtactgtacaatgtcaggggacagcgggagaggaaaagagcatttggtattgtgtcttgactgtgacttgaagccagcaagaagccggcttatgatacaaaacacctatgatctgaacaagccatattgccaggggcccagttacctgacactgcttttacttacggttccctcatccctctgaattgagcctactcttgatgatgtcacccctagtcttctccaaaatcccaaacatgggttttgacatctgcccctgaaatgactgcatgaaagggtgatagtggtcccaggacagaacactggttgcttactgcacggacacagcctcgggtgacgctagttaaccgccagcgtcagagcagtgcgggaggcagcggggagtgacagctctgccctcctgcaacccagctgcgtctggcggctctcaggcagaatctggaataggctgattaactggtatctcacgacacgatggaagagctcaaaacatgcaaatcggttatggggcataaatagagtttgctgagctcaccccggccacgtctcggcaagctccggggcccattcaccagggcattcggggaggcgggaggcagggagggaggccatgcagcttggagctcctcacctccactggacgtgtgtgcctcccctccgcaggggcaggacgcccgccccgagcccgccggccggcacctgcagctggggctgcacccccgcccgcgcccccgcgcgcacccccttcgcagggcttggcagcaggtgcctgctctccggagagcgcttcgcattaactttcccatctgacataatcatggagagaaaatgaagagatcccattagcggcaggctggcgggcgggagagcgcagggccagggccgggccggggcgagtggagggcgcctgtatttttagccagatgccgcgtaacttgctggcgctccccgcgccgcccagcagataaccgggagggggagcgggagccgggctcggatttcagcgcgggcgccggacgatggcagcgcgacagggcaggtccgggccagaccctgcggtgagtgcacgagctgtcgcggttgcccggccggggccggggcgcggggatcggggccggggccggggccggggctctgcgtccgtcctgcgggttgtggctccgcgcccggctgcccggcgccaactttccccggcgggtgcgggtgcgcgcgctggggctgcccttctgctgccgaggcttctagcaggatccagaggaaaattcctctggcctgaaggctgcggccgcggaggggctggagccggggttgggaggcagcgggacttgtggccggcctggaagaggggcacgggcgggagcgtggagccgccgccggggtgccccgaggggggccgggccctggccgaggccaagtcccctcaccccaggggacagcctggccgggtagattcagcagggggtgggagatgcacggccttgggccgggcggggacctggcttgcggcacgtctggcccctaaaactcagaaacgtgaggcgcccggaggcccccaggtagcaggaaatgaatggggcagaggaaggcagacctgttgggcgccctggcaagcctggagctctctgccgctgtccccttcgattctcgcagccccctggcaagatccccattttagcaatggggaaatggaggtttggggccttagatgagcacagcatcaagtggtcgagcagtgcatctcagccaggtcttccccagtgacgtcccagcccaccctgcccagcctccagggtcgggtgcagacagcacagggaaccccaggggttttcccaatgtcccgagttcgggttgagagattaagagggagcccagcacttccgctcaggcgtcttgtttcctcagtgacacctttaacttattcattttatttttgccaatggtagtcagactggggagcctggagacagtttgtaaagctgtaacagcacacctttctggaaggcaaaaggaaagaaacataataaaacacacactcactagggcccagtgttcacctctgtttctccatcgtcaagggagtaaaggcagggctaccaggctatgctggctggggacagctgtctttcctcataccccagtgcggctctcagatcccccaagcacaagcagacagctccacatcagggctgctgcctgtcttctggctgggctgcaggtcccccaggaaaggacctgaaatctcttcctgagagctctgacagtggctgcgttaaagaagctgcattttgctccaacaagaccccttgggaaagtggcattgccttatgactgtttacagcaattgatattagctcagtttccattcgcctttctagataggaattttgtactaaaaatcttgaggtcagtcatgatttgtcctagggaaaacttaggccaccccaacccccagagaaggtgtgaggaggccctggggttctctcacctgggtctgcctgctggtgtttcccaatgtcccctgctcatgggtgacagcatgttgacattctgcagcgtgcttccggcccctccctctcaggatactggagccccctcgcaccccatctattgctatattagtatctgctcaggaagtgcaagtttaataatagtctgggtgtctcaggtaaccaggattcaccaccctttcagagcagtcctgatgagaacttaattcctaggaagaattctgttcccttccttctcttccattccctttctcctgacgtgggcacagcctccaaacccaggcagaaggctttctccagccagagctgaactggagaggacccttatgagcactagaaaatgattaggccagcacagtggcgcgtgcttgtaatcccagcattttgggaggtggaggtgggaagattgcttgaggccaggagttcaagaccagcctgggcaacatagggagactttatctctacaaaaaataaagaaattagccaggtgtggtggtgcacgcctgtagtttcagctattcgggggaagggggtgttgacgcaggaggatctcttgagcccaggactttgaggctgcagtgagctataactgcaccactgggggaccactctggaagaaagagggagactctgtcttgaaagaaagaaatggagaagagagagagagaaaaagaaagaaagagaaaaaaagagaaagaaaaagaaagaaagaaagaaaggaaaagaaaggaaaggaaggaagaaggaaagagagaaagagagagagagaaaaagagaaggaaggaaggagggaaggaggcaaagaaggaaggaaggaaagaaggaaggaaggaagggaaatgattgacccaggaagcggtatagcacaatagttaagaagtatgctacctagactcaaatcctggccatgctacatattagctatgtgactttggacaagttacttttctgtgacttggtcacttcatctataaaaaggagataacaaaacacgtgccttgtgagattattctgaggagggagtgaattaatttatgtggtgtgtttaaaacctagggagagctttgtgaaagtaaacttgttttgttttgaaaggaagttcagggacatcacattgattaggcagcagggatgcaggcacagcagaatgtctgctgtgtgcagatccccgaacacgcacacaggtagaattagattaaaacgaagctagagatgaggaggggaagagacaccagaagacagctttggtggggtgcacaacagaggtgccagcacctcactggtggccagggcttgtggacacggtggggtagttttctgtataggatgagcaggcctcctggcctcctgatctgggaatggatgagccttggagagggccagtcattctgctccggtttgtcatagcccagagatggtcaggtttgtattttgttgctgttgttttttgggtcagtatgtgctcaggtaaatgttttgaatggaacacattggattctttggacacacctcctgccctgttgcatttgctggatgtactgaggacaggtcattgaattggagcagttggactacacagatgggcagtaggggctcagcagaacacaatggtaaagatgagtctcatatcccaacaagggccatttgctctgtagctgaaatattgcctggcccctaggaggttctcaatgaatactcatggaatggatccacaggtgcatgcatgcacatgaccgctttataacacaattgcttgattattcagatcaagagagcaaggacctatattctgagtgattattctctctttgccctagcaggatattggtcctgaaataggaccccagtaaatacattgtggaattaaactgaatgatgtgtagttgctactgggagtggcatcattatctgcagttcacctcccagatgccctgaggatcctgcagagtcctgactactctatgcctggagaagaccaaaaaaaaaaaaaaaaaaaaaaaaaaaaaaaagaaaaaaagaaagaagaaagaaagaaaaagctttagcaattgcacttcactgctaactatctaggtgaccttagccggtcactttacttccctgggcctcaattttatcctcagtgacaagaagggctggaactagatggttcccttctagagacctgtcttggtctgaatagagtgctcagggacagagcctgagtgggacctcctagcatttttcctctgccatggattagctctttaacggccgaggcatataggcctgcccagccgccagcctgtcagggctgcctgaacaccctcaggcttgaaatggccaagaacgcccttggggtcaagggcagtggaaaggcatagacttcagtggggtacccctggattgaatcaccccaagtatttatctgcagaacttgggcaagttattaacctctcaaaacctcagtttcatcacctctaaaatggggataataattatacctacccacaggttgttataagaattaaaagatataatgctggtaatacatttgtcccaatggttggtattataattttagtattctattatggcaacaacagaaatggtttagctttcctcaatctagtccatatggagcttcccttaccctctatttatgtgcttgtctgtcataaattttttttttttttttgagacagagtctctctctgttgcccaggctggagtgcagtgccgcaatctcagctcactgcaaactgcctcccaggtccaagtgattcttctgcctcaccctcccaagtaactgggattacaggcatgcaccaccatgcccggctactttttctatttttaatagagatgtggtttcaccatgttgaccaggctggtctctaattcctggcctcaagtgatccatctgccttggcctcccaaagtgctgagattacaggaaccaccacgccctgccagtttgtcataaatattcttcttttcttcctggattcagtgctttgagcagtcagtgtcattagtggatattgagtctatttttatccacccattctcaggttttcagcctgaatcctattattgtgccataaacggtagttaattggtgggagaaatgtctctttaacattcttattcttggggaataatatagtgtttttcctaataactgaatctagacagactttctgaatcagtagcataagtaacatttatctgagagactaaaccttgactgggttttctctggaaacccagctcatgcctggagagccaacagcttgatcttcatttctgaaatatttcctgccccacagatgccttgctgaggaacctaggatgtgaatgccatgtgctttaggtcaagggaggcctcgccctagcagacacttaatgctttggaggattcaaaagagatagaagacttggtccctgccccaagaagcaaacagtttggctggggagacaagacttgcctgaattcaatagctagagaaagagatattttaagtgcattaaaaaaaaaacaagctcctgttttgtggttcctagatttaaagatggcaaatactgagtgtctaagcatagtgtcattcatgcaggaagtagccaccatcagggccttgaagggaagaaagattggaagtagcaaaccagagggagatggagcttcagggcccagggaggaggaaggtgcaggccaggaggtagacagagcatgagaatgtcacagaggacaagggaggtgagaaggggctcctgccgctgtggggacagcgagatgagtgtgcctcatgaacagacagccacagggcttggacttgaacttgagcttacatcatagggggcccatgtgggacctgaggttggggagggttggcaggaagtcaggatttggggaagaccagttaggcagggatggaggaggttggctgggtgaggcagggatggaggaggttggctgggaggcagagcgaggaagcagcatttctgcaggcctggggttgtgggtgggggctgggaggtggtgtggggcagcacctgagtgtggagggaggaccccctgtctggaaggctggagaaccctactgctgatgccctagggactccctgtttcagtggtgaagacgtgaagcgctgctttgtggaggaggatgagagttccatttggtcttcggctgtagatttggagtcttctgtgttcaagggtgttcaagggtggtcatcactagtgtgtgcatgagtttcccatggttgctgtaacaaatcgccacacacttagtggcttgacactacggaaatgtgttctctcgctgtctggaggctggagatctaaattaaggcctccacagggacacactccctccagggcttcagggccttcttctatgagcctccacctcccagaggttccttgcttccttgtgcatggctaaagtcactccagtctctggctctgtcttcacatagtttcacctctgtgtgtgtgtatacatgtgtgtgaacatgtgtgtgtgtgtgtgcacacaggtctctgtatgtgcatgtgtatgtgtgcatgtgtgtgtatctgtgcatgtgtgtgcgtgtgtgtatatgcatctcttggtgtgcatgtgtgtgcacacacgtctgtgtatgggtgtgtatgtgtagatttgtgtgcacacatctgtgtgtgtgtgtgaatctgtgtgtgtgcgcatgcatctgtgtgtgcatgtgtgcatacacatatatgtgcatgcatgtgtgtgtgtgtgtgtgtgcatgtgtgtcttctccttttctgtcttttctaaggacacttgtcattgaatttagggccagcctaggtaatctaggatgatctcgtctcaagatccatgacttaattacatctacaaagacttttttttcaaataaggtcaccttcacaggttccagggataagagtgtggacatatcttttggggggcaccattcagcccactgcagcatgttttttttaggagggcatgtagaggaaggagacaaagtgcctgggtggagaggaagccactgtgggtcttctgtgggaatggcgtcacacgcttctcccatgtgtggcttgtcatatgaccactctcaccctttcaactcagccttgtatgcaactatgtgccaaacactgtttatttcttttaagcatcatgaaaaggggacaagaaaggctttactctccccagcttacaaataaggaaatagaagccaacggtgtctaagtacctgagggcactcagctagacccagtggagtggctctgagtctaggccacggactccaatgcctgaggactgggctttaatcattacatttgtctttgtgagtgtattagtctgttctcacactgctaataaagatgtacccgagactgggtaatttataaaggaaagaggtttaatggactcacagtccaacgtggctggggaggccttacaatcatggcagaagatgaaggaagagcaaaggcatgtcttacatggcagcaggcaagagagtatgtgcaggggggtctcttctttttaaaactatcagatctcatgagacttattcactttcatgggaacagcatgggaaaaaccagcccccatgattcaagtacctcccaccagatccctcccagggcacgtgggaattatgggagctacaattcaagatgagatttgggtggtgacacagccaaaccatatcaattagtaaactttattttattgtcctcagctctcaccctctctggctgtcactcatctttaaaggaaacagatgttcctgggggcaaggtctgagatgcatggggtgggtgacgtagcagcagctaaggaacagaagagcttcactctcatttaagaaatctgttggggggcgcctggtgttaaagctgagaccgagctggctgcagagctgggaggttcggctcatgaatttctgagccacactacctgcatctgagtcctggctgtgcctcctccctgctgtgggatgctgcacaaggcacttctgctctctgtgcctcagcccactcatctgtaaaatgggactctgcaatcccacttacctcttgggtattccaaatgaggataaaatgcttatctgtgcgtgtgcatgtgtgtgaatatatattatagtcatccttcggtatctgtgggggattggttccagaaccccctgtagataccaaaatccacagatcctcaagttcctcatgtaaagtgatatagtgtttgcatataacctacccacatcgtcatatatactttaaatcatctctagattacttataatacctaatgtaagtgctttgtaaataattgttgtacagcattgcttttctgtattactgggtttttttgtttgtttgtttgtttgtttgtttgtttttgagacggagtcttgctttgtcaccaggctggagtggagtggtgcgatctcggctcactgcaacctccacctcccgggttcaagcgattctcctgcctcagcctcctgagtagctgggactacaggtgcacgtcaccaagcccagctaatttttgtatttttagtagagatggggtttcaccatggtggccaggattgtctctgtctcttgacctcgtgatccacctgctttggcctcccaaagtgctgggattacaggtttgagccaccacgcccagccttctgttagtattactttttattttagtattgttatttttaatttttttcctgcaaattttccatccacagttggttgaataaatgggcttgactgtatatgtaaagtgctaataatggctcttagcacatagtaagtgctatgtgctgtttacttgacagcacatagctgtttgtttacttaacaaaaacacagggctgggtatggtggcttatgcctgtaatcccagcactttcagaggccggggcaggaggattgcttgagcccaggagttcgagaccatcctggggaacatagtgagaccccatctctaaaaaggaaaaacagacaaatagaaacaaaaacacaaaacagctccaaagagcccacgcttggttcctttggtgcctgcattcatgattcttggggccagggacctctgtgatattgcaaactcttcagcaagactgtggagcccctgaaacctcagagcagggagacaccaggctgtgctgtgcgcttgccataggaatgggctccccctcaaaggctgattcttcctgagtccaagccaagaacgtttgcttataaaaataccaaaagggggccaggcacggtggctcatgcctgtaatcccaacactttgggaggccaaggtggaaggatcgcttgagctcaggagtttgagaccagcctgagcaacatagtgatgccctgtctctataaaaaaaaaaaaagtttaaaaaaatagttgggcttggtggtacacacctgtagtcccagctacttgggaggatctcttgagcccaggaattcaaggctgcagtgaactgcgcttgtgccactgcactccagcagcctgagtggcagagcaacactctctcttaacaaaacaaaacaaaaaacaaaaaaccaaaggaagggaggcctgggtgtgaaggcagtccaaccaggggctctcaggctcctgtgcacacctggtgtcactgtgggcaccagggtgccacatcagaggatgcaggggctgctgcgggggcctgggacttgaacggggtggagaagtcattaatacacccaggacactcaccgcctgttgtttttcctcacaggccgatgctgctaccagctttctgagagcagcaagatcaggtaacttggacaaagctttggatcacctgcggaatggggtagatattaacacctgtaaccaggtaagtgggatggaggcaggcctgttgtctctgaagagtagctcttgcctgatgccatttcctgagagctttgaaactgcctctattaaccttttctcagtggcctcaaaactcccccagggcttctgcctgtggaaggccctaaccttgctgtttccactcctgccgtggcccagggccccacagagaagggctgatgcctgaacagtgtgggcgaggcccgcacagatcccctgcggtctcctcgcttagaagttgcaattgattcccgctgttgtcttagaatatgtggcctttgaattggggcaggaggaagagcctttgaaagatgctgtgtcagtggggatgttcagtctcctttgtccaccagcagtctgtgtgggttctcggctagcctgagaagaaagtcgaggaacgaggccccgcttgtgttaggtgctgacaaaggcgagtgggctcgggttgaggatggtggggctggtgcagaggctggctctccagggctcctgagtgacacagccaagccttagcttcagaaggggctggcgaggaaacaaaatgtgtttgggttgggttggagggcagagactcgggcttggagccaaagatccaggaactaactaaatagagaggcaatgaccctccaggaagggaacaggtgtgtggcttgggcttgtggattggtgacaggttttgtttgtttgtagatatttgcctgccaattaagttgtttagttacacatgctaattgtttctaatttagaatacagttatccattgcgactttttaaaaaccatcttagccattaaaaatgtgtgtttaattgtggtcagatatacagcatagaatttcctgtcttaaccatttttcggcgtacagttcaatgggattaagtccattcatattatcctgtaatcatcatccatctccagaactcttttcatgttgcaaaactgaaactctgttctctttaaacactaacgccccatttccgactactccccagcccctggtggccacccttcaacttccagtctctacgaattttactactatagggacctcacagaaacggaatcctgctatatttgtacttttgagattggcttcttttatttagcatagtgtcttcatggttcctctgtactttagtggcttgggtgacttttccaagccagcagggccagattttctgaacgtaggttaggttttccatgggcgacatgcctctgtcctaccccctcatctactgtttccctatccatcctgcccctgtttaaaatgcaaaatactatccggtgtagtggctcatgcctgtaatgccagcactccaggaggctgaggtgggcgggtcacctgagctcagcagttcgagaccagcctggccatcgtggagaaaccccatctctattaaaagtacaaaaattagccgggcatggtggtgcatgcctgtaatcccagctacttgggaggctgagacaggagaattgcttgaacccaggaggcggaggttgcagtgagccgagatcatgccattgcactccagcctgggtgacagagcgagactccatctcagaaataaaataaaatagaccgggcgcggtggctcacacctgtaatcccagcactttaggaggccgaggcaggcagatcacgaggtcagaagttcgagactagcctggccaatatggtgaagccctgtctctactaaaaatactaaaattagccgggcatggtggtgcgtgcctatagtcccagctatttgggaagctgaggcagaagaatcgctagaacccaggaggcagaggttgcagtgagccgagatcgtcgtgccactacactccagcctgggcaacagagtgaaactctgtcttaaataaataaataaaataaataaataaataaataaaatgcaaaatactacctgcctccattcctagggctaagaccccatttggattcagttggtcttgcagtggcagaaattcacagctaaaagatcagaaagaatggagcagtatggtatgtgatgggaaacagaagtaggtgtgtgataagaagcaaagaccctggcagtgcacttcagagggaaagtgaggtatgtggacctgactggaatttgcaaactggatgaaggaccaggccccccgccccttttctcatccctccacccagaaatgccaacatccacatatccacagcccagaggacattgtggtggttctaacaaagcatctgccaggctggcctttgcatagcaggttgaaactcagcccattttttgatgccaagaggtggatgcagcaaagcctggaggcagggtgagagtcttggtgtgagagttgttcagaagacagggtctgggaccttcttagcactgcacctccagaagcagctgcacaggctgcagctgtgttgccccagccccccataggcagggtgggttgctcgctctctccacctgggatgcattcttgggcttgtagagatgcacacctggaggctttctttgttcttactgtggctggagaattgcagatgtgtttctccgcagtgcagttctcagcggaggtgaatcacaccttcagaggccttccaagggttaagattctagctctcaaaggaatccattcagctgaaatggggacaactgaacgtgtgttagacttgagccagggctcattttctgtgtgaaattggaagattttgatgccaccagggaatagctgtgtcctgattggtctcccgttggagaggccttgggtgtaactgccttgtcactctgccttctctcctcagagcacctcttcggttcgttttgggctcagagagcagcaagcaccgaggtattatttgcactttattgacaccatttccgattggctcagcgccagtgacaagtggctgtcagccctgcttcaggctgaggggaggctcctgcctcagactcaagactgcagtcctggctaagcctggcctctctcttaaagaggacactgccacaagttatgaaatgagcgtcagaagggaacgaaagacaggacacaccaagtgcaaagccccttgctgctggttaattcccacagctgccagatgtggccctgttggtccctgttttatggtctgtggctgagcagaacaggtagctgcaggtggctgcgcctggaaaggagctggtcagggttccctgaacctcattctggttgcacagggcagtttggttttgctgttgcagggagagtcctggtggtgggggagggactgcagtggctgaacccatgcctgcatgaaacccacgaatgcacccagcgggacgatcctgcatctgcgtaatgtgcacagggccagcctcttaatgctactagagctttctgctctttaaaacacgcataaaagcaagctcttgtcccggggtcatggcaagagaatttgctttcggcttgaatcttctgagctgatggactgtggtggcagtaacagggcaaatacttatccttacataagtaacacactttcaaatagtatgtttttgtggaaagaatgcgtactgtttgccataataggaagtaattactctaagtagcgtggaaagaggaactcttggcttatataagagatgtctgaatattcagggcagttccttgttgtatagactgtgtctactaatgttctatcatcattatcattaccatgtctacagaaaagaagaaatttatatgtaagaacacacacatgtgtgcatacaggaacccccttatgtgaatgccaattttaaaatttattgtttgcactttagatgcctgtgtctaatgtacttcctgtgcatctccacgtgtatatggagagctgggctgaagggatagaataatttcattttaaagtcacgttccttatccgttctgaactgtagtctattggcagtgagagctattaatcaaataatgacacaaacagatatgcataccaaaaactatgttaggaaccatgaatggaaggcagagagtatatgagaggactgccctagagtcagaggtcagagaaggctaccatgaggaagagacagctgaggtgagggaggagcagaggcaaataaggtgaagcaagggagaacatgccggtcttagagagcagcctgtgcaaagccccagaggcagagaaaggagcagagggttgaaggaaggccagagtgggtgcagtgcagacagcacgagaagccaggcaaggtggagctgggattgtgctggagcttacaggtaggggcgagagtcacaacactcagcgacagagacagggacgtaaagatgggaacaggagacactgggaactatgggtgtgggagggcgggaggagggcatgggtggaaaaactaactattgggtaccgtgttcactacctgggtgacaggatcatatgccctccaaacctcagtgtcatgcagtacattcatgtaacaaacctgcacaggtacccccgaatctaaactagaagttgaaattataaacaactgggacagcgtgcccctgggccagagctgtgtgtgtgcatgcatgtgtgtgctaaccagctgcaccagatgttaaccccgtagttgctgactgaggggaaggggtctgggggagggggacagtggccagagcagcagggatggggtacttaagagcctgcagcaggccgggcgcgatagctcatacctgtaatctcagcactttgggaggccgaggtgggcagatcacctgaggtcaagtgttcgagaccagcctggcctacatgatggaactatttagtctccactaaaataaaaaattagccgggcatgatggcaggcacctgtaattccagctacttgggaagctgagatgcaagagaatctcttgaacccaagaggcagaggttgtggtgagccgagatcgagccactgcactccagcttgggcaacagagcaagactctgtctcaaaaaaaaaaaaaaaaaaaagagcctgcggcagtggccactgacctggaggagtggagcgtttcagcatttaacacctgcacagctgtactgctgtgtcctggttgaatatcccccccttgtagaagccacatgaaggattccagtctttctcccgagcatagaggaaagtgaaccacagattcaagcacaggagtgacgtgatcagggttgtgctttaaagggtctcactggctaccgcatggaaaacaggcggagggcccagcggtgcagtgggggggggcctgtgtgtgcccagcagcgcaggagggacgtgtgggcatcttggatgagggtcatggctgtggagatggagcaaagccaagcaggcttgggtgatggattggatggggcactgaggggaagtagactcaagaaagactttccgagggctggcttccacggcaggtgggtggtggcaccatccactaaatgagggatgctgggagcagaccggtgtgtggaaacacgggggaggagtcaagagcagagctgttccagatcctggtaaggaggctctgaggaatccaagcagaaatatatagtaagcagttggatatttgagcctggaactcagataagaggtccagcccaaagatagatatttggaagtcattcagccttcgaggaagtcgagtgctgacgggggctgatgagagcagggaggaaaggcatgttgaatatactcccactcgcctgtgtggggtcattccacagcactcattaaacacccactctgtgccaggcctattctaggcactgaacaagacagacaaaatagtctgcgcgctcgtggcctgtgcatgctggtgaaggaaatagacaatagctaagaggatgggcacatacatgaagtcagctgatgggagacactggggaggaggaaggtcaaggtgactatttcggtggggtggttgggagggctctctagggagacgactttcaagaggtctggaagaagtaagggagagcgccatgtggtttctggggaacagtattcttgggagagcaggaaacacgtgcaaaggccctggggcaggagtaagagtggtttgcttgggggaacagtgaggctggagttgagtgatggaagggaaggtggtaggcaggggggttggaggagtgcctggggtcagatcaaagagggcttgcattggtgagggcttagattttgccataagggtgaagtcatttgaaggtgttacacaagagatgcttatgctgatggaggtttctaaacaattgccctcgctgctgtgtggaggatagactcagagcacagggacaagagcggcaagactggtgaggaggctggtgcgggggccaggtgggaccccggggtggctttgaataatggggagagaggagaggtggggaggccagaggacttgctgcccaggcttggagtgtcatcaccccagatgtgttggtctcagcacacattttgccggggctccttacgcagcctgggaatgggtcattcttccagctagagcagccacatagcaatgggttggtaggttccatctcagctcaacagccactgtgaagacagccttgatccccatagcttgaagccattcctgcctttgtgatgtgtcagtacctctcttaaggctcaagcctagctggtcctactatgtggcttggtaacatcgagcaggtcttccctctcctggtgggctccaagccgcggtgaggcaaaacccatgattggggactctgtttctccacagcgcctggcataggatgtgtcctatggtagatactctggcatttgtcttaataaatggccacataattgtgcacagacccatattagcttcacatgctcagtttccagaattattgttagattaatatcaaatcaaaattttttctcatggagactatagcaatacaaaaatactttctgggatgaagtaactgactatacacattgatgagtcaaccaaataaaataaaaccagaaaagagcagtgccggcctgtgtcccctgaattcctacaattgtcagattgacatggatgttccactgggggccgtgagctggaatcccgggggcaaaaagcctcactcttttagttttctgttctattccgatgatgctgacacttgctggttcatttggccttcctgatagcaaagaaagggcttgagactccaggagataattttccatgaaaaggagaagccttgtcatccacaactcagcgtaaggcagagttcaaagtgaagacttcccagagcagcccaggcactgttggtcctctttgcctgtctcatttttctccatagtgcttgttactgcgtgccttcatatgcatgtatgtgtctgcttatttttgtcttcactaaattgtaggcaccttaaggggagagggctttgctttcctcattgctctgtgtcaggatcctgcttaacctatagcacgtgctcataaacccagttgacagactgtgtggaaaaaaaaaaagcagcaatgttgtttgctatagctatgaatggtgaaagcttatatattttatacttagtccacgtaggaactagactaagcaccatcactttgtaaaagccttgtgcaatcgtgcatacttaggataatgagcctgcaataagcatggctcagatgctggcgttagccccacaggtcgagtatttggcaatatttgctgcagtgtccagaagctcgaccatctgaacgatcacaaaagcatacacgatttccagtgcgaaaacccagcccaggaaagcacgtgaaaccatgccagctccctggatgtgccctaaagttccacatgtgcattaggaagccctaatgtttatcttgaaggtaaagggttgcgggcatttggaataaatggagcacctataacaataatttctgctacagtgtagtactttctacagcagccaaattccaagtcttttgatcaggatttcttgtgctctggtgatggtgataattacgacctttccaagctatagaatcttagggcttagtggagctcacggcattcaatttccattttatagctcaggaaactgaggtctaaaagttacttctgaatatcatcttatgctgtatgactttggatttggggagttgggcttaagaagtccaagatgaggctgggcgtggtggctcacgcctgtaatcccagcactttgggaagccgaggcgggcagatcacctgaggtcaggagttcgagacgagcctgactaacatggagaaaccctgtctctactgaaaatacaaaattagccaagcgttgtggcgcatgcctgtaatcccagctactcaggaggctgaggcaagagaatcacttgaacctgggaggtggaggatgtggtgagctgagatcgcaccattgcactccagcctgggcaacaagggagaaactccttctcaaaaaaaaaaaagaagaagaagtccaagatgaggccaggcgcagtagctcatgcctgtaatcccagcactttgggaggccgaggcgggtggatcacctgaggtcatgagtttgagaccagcctgaccaacatggtgaaactccatctctactaaaaataaaaaattagtcgggcatggtggtgggtgcctacagtcctagctacttggtagtctgaggcaggagaatcacttgaacccgggaggcgaaggttgcagtgagccgagattgtgccactgcactccagcctgggcaacagagcaagactccatctcaaaaaaaaaaaaaaaaaaaagtccaagatgaaatttctctgctcattcatttattctgcaaacatttattgaccagttacaatgatccatgcaccatgctagagactagggctaaccaaaatgaataaattcgtgccctgttttcaaagaactcagaggcaggtaaaaggtccagcttgcagataaaagattacaaattcagtatcgtaagtgccatcctgaaggagtacaggagatgtttttgtccgtgtaatcattcattcaacaatttttttttttttgagatggagtcttgctctgtcgcccaggttggagggcagtggcaggatctctgttcactgcaagctccgcctcccaggttcatgccattctcctgcctcagccccccaagtagctgggactacaggtgcccgccaccacgcccggctaattttttgtatttttagcagagacgggatttcactgtgttagctgggatggtcttgatctcctgacctcgtgatctgcccgccttagcctcccaaagtgctgggattacaggcgtaagccaccgcgcctggcttcattcaacaaatattttttgagctgttctaatgttccaagagccagccagtcaaagatgagcaggtcctgggacctgcccttatgtcgtttcttgtctaagggtagtggctggcttgctaatgagtcagagaaaggttgtgaaggaaggatacaagtctccgagtacagaactgggaaacaggaattgctgtgagaaggaacagactgcaaaggctggagtgccaaagggcactggggcagggggcagttcggggaggttggggtacatgaaatgaaagagggtgaggatggtggtcaatccagctaaggaggttagagctagatctgtatagatctagaacctggcacttttctctgtcattgtctttttcttaggaactgttgacaggcatagaaaaatgtattaaactacatagttctctgatcctagctgcaccccgaaaacacacagaaagccttcctaaaatgatggtgttgtggtattaaacttctttagacttgctgccttggtgcagctctggaatagggatgaggaagaaagaacgtttcattggagccctcacctgggagaagagtgttctgtgttaaatagttaaaccagatatgcagctaggtgcccctatgcctggcacctggtacctgcgacaccgttaatgctgacgtcaccctgagagttggttagagcaggtgcttgaccagggaggctggggagactcagagaggtgaagagtctcagagcccaggactgagacacccagcccaagcctctgtactgactcagaggatggatttgacactgcgcagcaagcctgttattgctctgggtgatctgccccagactggtttcattttcccttcctctgcagccaaggaagagctaattgaccagttcagttacataaaaatcttcatttgtagtcacagcagggacattccatggaatcctagggactgggaaaagggtgactagcaccttcaggaacgatccggaatgtagtgcaaggaacacacactctctaaactccacattatggtttcattgctctaggaatttagaatatgaagactagacatgatcttcatagtgcttagagacaaagaaaaaagataggcctgtgtgtggcaggttccatgaaggtgcattgaattctgcaaaccttatgcaccaggctccatgctaggacctgattaccaaggtgagcaaaacacaggatctcaaagaattcaggcctttgggatagacaggcacaagcgcagataaatgcaattctgtgtgatgagggtcttgagagagttatcaaggtccgtggaacatggccaagaaagcaatccacttttagggggctagaaataaggtacagtgtggcaaagagaggggacaggtaaagtcacaggcaaaatgacactcggtctgggccttgaggaagatttgcctctctgcttgttagaggaaacgctgaaagcagatcccatggttgtgatgagactagaggaggaatgagaattggccacgattgtttgcattcgattgacttctttggtgtaaaccctttctgtccgttttgacaagccttggctctgattttaactcccttacgttctgcgaaaccactgttaacagtttatatgaatcttggcatattactttttctgtacatgcaaaacacatagcttaactcttttctgcaagctgttacgttgtcttattcttggaattatggaattcagacgaaactggaagctcagagcagttttgtcattgcaaagcagcataaattgaagcctgggaggtcatagataaggacagtttagaagcccagggttcctttctcctgaccccactgcccttcttctaaaggtctgggtcttttttttttttttttaaagaataccaagatctcgggcatagatgctctttctagtccataggagatattcttagatgctgaactgcatttcagagtcccattctctcattaactcgagctcacacttcctcctccaccttccccagggcccatcagcctctgcagttgatttgctgctgagatgcaggatttctcagagcacagggctgctgcgagttctgtacaatcaaaatagaaagaaggtgagctgaggttgattcatttccttgcagagctctaaaatcgttgtgcattcctttttcttaaggtaatgaaaaggattagagtgtttttcctcctcatgagtatccagcaaactgtgaatcctaagcgctacccaggcaggagggctaaagttagattgcaacaaagcaaacagagaaaatgctcagagccggttgcctccctttccatctgcgccacctctctctgagtttgtgctgtcctctcagtttcttctcttattctgtctttcctgtccctaggcaagagacagatttgcaaaggagatcaggtgtgattttccactagggttacggcagttgcttcagctctgcctggcttctgattccttagattccaagatcatatatttttagcagacctttcccaccaagcagtctctggggagccataaactatccgggttagaaagaggctgcaggtggtatggccccgcagaacgagaggcctgccctccagaagaggtctcccccatcagcgggtttccctgtgggctgagggctgttctcttagtgtgtttgattgcactctggggtttccatcctggaataatatcagaactccagtaaaggtcgtgcctcacagttcctttacaaataggacagatgcccagccactcagaaggctgaggcgggaggatggcttgagcccaggagttcaagaccagcctgagcaacatagtgagaccttgtcctacagaacaaatcaataatttaaaaattaaacattaaaaaacaaattagccaggcatggccctgcacctgtagtcccagctactcaggaggatcgcctgagcccaggagttcgaggtttgtggtgagctgtgatctcccctgtgaatagccatagtactccagcctgggcaacatagcaagaccccatctctaaaagaaagaaaggaaaaaccagaacagatagatgtaattataacttcatactggctgtgattcccaaaatgtgtagaagccccagcgggccacctgtcccctacttagaccccagaattacccccacaacatcactcctctcctccagcagcctctgcacctcaccaccactcctccttacctcccattaaaaaattgtttagtagttccgaatctatagaaaagttacaagaacgtacagagaattcccgcatctcccgtgtctgcattatctacgcccgttcttctacacttcctgtccctgttcatctgtctataatgtaggacatgtgacctgattcggcacatccccagacagtccagtgtacaccatccaaaagtaaggacactttcccacgtatccatcccacgtgcctgccaatctggaaatcaacactgatgcaacacaaccatccaatccacagactccattaggattttgctaactgtccctcctctgacaatttctccctctctctgtgcctccttccttcacatctccccgccccttcttctttctccctccgctccctttcctgctcccctccatcctttcctctctctgtctctctgtctctgtctgttttctcacgctgtctctgttcccctccacctttttctgtctctctttctctggttcagaaatctctccaggaagatattttgcatttagttgtcatgtctcatcagcctccttccatctggaataggccctcagcgtgcccatttctcatgtgtttgactgttttccatgctgtagtttgagcctcagctgtctgtctgatgctgcctcatggccatatggccatgctggacaggaataccatagaaatcatgctcccatcgggcgcggaggctcacgcctgtaatcccagcactttgggaggccgaggtgggcagatcacgaggtcaggagatcgagaccatcctggtgaacactgtgaaaccccgtctctactaaaaatataaaaaaattagctgggcgtggtggcgggcctgtagtcccagctacttgggaggctgaggcaggagaatggtgtgaacccgggaggcggagcttgcagtgagccgagattgcaccactgcactccagcctgggcaatagagcaagactctgtctcaaaaaaaaaaaaaaaaaagaaaagaaatcatgctccctccccactcctggggatgttaatcttgatcaccaagtaaagttggtgccagccacgtttttctactataagttcactgcttttccctttgtaattgatcagtattgtgttgagggagggaaatatttcagtctattaatgacattaatagcccattaatgacatctgcctgtatcagctactgctgtggtggctccagacagtgattcctcatttccatcatgtcttctacattttttagctggcgttctactaaaggataagctttttcttttccccattaatttattttttctttatttgtgtagagctgtttggactcatggatttgtctcctatggatttgtcttcgtttcaacctgatactcccatgacttattttaatggtcaagtctaagctgggccaataaaagtccttcccatcagttggcttcttcatcctttgacatgtcctcatcattccttgagcattttcctactttctggcacaaggtgccccaggctcattttgtacttgccctgccccacccctggctcagcacttctccaaagatccctggttcctgttagtggagacagcacttagacaccagggtccagcccccgatgagcccattgctccgggttgtcatatgtctgtgtgcatgcgtgtatgcatacatgagtctgctaactacgtctacagctgtctatgtatatatatatatatgaagaatcaatgagatcacaccaatatttctggttccagcccagtgctcggaattctttctagcctttcctctccccatgtttgtacagtccttcacacagcaggaggcctgaatgccactgatgcccgtcctccttaacatattcactgacttgtttgctcagtgtgatgacaacctcccaaccactccattagctgtcctctttctcagaccccagacacgctgctgcccatgccctgcagggcacctccctgttcactgccctctaaggccgacatctccagctgggtggggagggaaggagaaggatgagaagggaagatgggaaagcactccttcagctttgatttcgtttctgttttggttgaaaatttgatgtaggcgatttgaggaaagaaatcaaaacttatatagctctagtaatttttttgatgtgtctcagttcatttcctcttctagacaaactatcatgccgtcgctccttcccttcccatcatctgctctgcctcctgtggctccatggtctttgccttgctttcttccctgctctttctttcattctcatcagtttcaggatttggagtaagtatggcagtcactccagtccttcttttcctctctgtaaccccagtttaggctcttctctcctactctgctgcagggctgcagacctgcaaatgtaatatattctgttgtggtctcactccacaaacaaggaccaataatagagcaaagctagaggtcacacatgtacaagttggttgctatttgcggaattaagcttctgtgacatcgagtatagcacttgcttgtttataataactcaacagagaatccaaattgaataggaaagtgggatatgaaatatatcccactaacctaggatattaaatagaggagtccactatgtagacaacttcctccttatcacaggcaagatcttctgcctggatctttgctgcctgcatgggtaaaggtaaaagcatctaggcatttcttttctcatctttcattttattcactctggggtcctcagactccttggtgtctctgccactgctatcgggcctattctttctaggactgcggtgccttccatccccataatatcttcccctggccagtgctcccttgcctctgggcctggctcgaccaatcattggataatagatattgattgatgcaaagtttgtgtttcccgagtgttatatgaacatgttgcctaggttctctggaaacacagctcaaagaaagggagtgggggactgagcagtgaatttcaggaggtgtggggtggggaggtcctcagtcacgggatgcagctgaagctgcctgctccatagaggcagggccagccttgtgcacgggtgaaataaacagctgcgtggaaaggaggtgtgagggctgtgtgtcctcatgggaatgtaggcattcacttttgagatgttcttgcagttttgcagagacaccaaggcctttctatttcaaaccgttccccttctcttgacaggaagagttaaattccccgtgtctcctgtattcatacatttggaaatcaattagtgcaactggggcaatcagaagagctaaacagaggaataatttaacgagaacaaatgtctggaattgtgtattttgccaatggaatttctcacagttggtgcaagaaaatactccacattgaattaatcaggctgaatgtgacttttttcttcttcttcttaaaaatgttaaaagaaacatagcctagctgaggtctccttccccgcccatcacacagatcgcttttcagaacaatcctgtcagttgacattccacctgaaaaagagcaaaggcaggtgcacagctctaggtgtgtgtgcttggcatgaagatttttgccaaaaagagccttaaaaggttatctcctgtgttaggaccatgtggaaagagatcatatggggacagctggccttaagggctcagtacagggagtatgtaggatgcagaaggctgcagagagcatggctcctaccccgacaatgacaaaaagctcgataatttacaaagtgatcattttttcctgaacccatctcatgcctgcctgaggtagtaaggcagctgagtaaacagaatttcaaacagaggcaaagccctctaagaagcgggccacgtaaatcgcttcagctttggcagaggtcaggaaagagaggtgttcaccatacaagccaaaatctttttttttttttttcaggtaaggtctcactccaccactcaggctcaaggacagtggtgcaatcatagctcactgcagccttgaactgctgggctcaaggtatcctcccacctcagcctcccaaagtgctgggattaaaaaccatcacacccagccaccaaaatcttaaaagttcttgaaggccaagtgtgggccagtgtgtctggaacaggcttttctccacggggcccccatgagaagtattgggctacgtcaggagccagaggaggccccctcgacagccaggtgtgtaggaggtgacctgtgactgtgcaggcaggggtggagggaggaacggacacaaagctttcaccgcttctccagatctttccctcatgtgaagcaaaaacagaccctctcacctttatttttatttttgaaattgtggtaacatttattctgagaataaaacaggcctcccctcccctacctccatggggtgctgagaggagggaagcccagttctgggtggagtgggttggaagccccacccatctgtaaatgggactcccaggtccccatgggtgcatgaggtgaacaaggcaattgctcttccccacccacccagcatcctcacctgccctgtccccctcctggggaccagagatccctgcatggccagaagccagcccagcctacctgtaagagcaggcctgttaatccagtgctgtccaggtgtgggaggcagtgcctggccccaggctgaagcccacaggtctgccagttgggcctggtttgcgcctgtatcccaggggacatggttgagcaaagacctgtgtgtcagccccagaggcctgagctggcttatccagcactcactgcaccaactcaggaaccttaatttgaagtagacattgaggggtggtgattacatgaatgtgtatatagagtgcacgcatacagagatacaccaatccttagaccgtagacctaggggaggaatagaaacaaactgcctcagccaggggaggggtaggaaacattcctgccaatgacttgctgctgtagggaagataggagcagccaccttgggactcctaggggaggggctgtagattgttttgggcccgggattctacaccaataacaagcaggcaattgggcgtggtggctcacgcctgtaatcccagcactttgggaggccgagacgggtagactacctaagttcaggagttcgagaccagcctggccaacatggtgaaaccccgtctactaaaaatgcaaaaaattagccaggcgtggtggcagacgcctgtaatcccagctacttgggaggttgaggcaggtgaattgcttgaacttgggaggtggaggttgcagtgagccaagatcatgccactgcactccagcctgggcaatgagagtgaaactccatctaaaaaaaaaaaaaaaatcaaaaacaaacacaaaaaaaacaagcaggggtcgactactgctgggggaggagcaagaaactcacccaagaccagtgcaagtgagacaggttttgctgccacagagaagggggaaggattgctaaacatggaaaagaaatcccaccttagagggccagatgtacagagcctgcctaatactgaagctggagcacgacaaaagagaacatgcccattcctgccagcctaacatgttgtaataaggaagagcaggccactgctgggagaagagtaggagcatggagaattacctcatttaaggcccaggcatgcaggatggctggaagttgagggaggtcaagaacactcacacaaaaagcccctggcaccccagctccaactcaaagttcaagataaccgcagtctacctttgtaagaatgtgaaggctgtggtgcactgaaagtaacaacaaaactcaaactcaggtcaacccctgagattgactcagccttctcacctccatgctgacaacttcacagaagaagaggcatgttgatttccagccgtaaatactatttacctcagtctctactgctcttctatgcttgatgtctggcactcaactaaaaattatcacacaccaaaaaaaaaaaaaaaaagaaagaaaaaaacaatgaactattgtcgagagacaaagcaataaacagaatcagacctagagatgaccacaatgttggatgttggaagtattagatggactttaaaataactatgattaatatgttaaagtatctagtgggaaaagtagataacattcatgagtagatggaaattttcagcagagagatgaaaactataagaaaaagttcaatgaaatgctgaaaacaaaagacactttctcagaaatgaagaatttattcaacaggttcatcagtagactggacataactgaggagagaattaaagaacttgaggataagtaaatagaaataattcaaattgaaagaaaagagagaaaagagggggaaaaaacaaaccaaaacagagtagccaagagctatggaacaacatcaactggtctaaaacacatgtaattggagctccagaaggcagtatctgtaggaaaaagactctagcgaactggtgttttcctccagggaaagccatatggttaaaaaatggccacaagtagttattgcttttctccccagcttctaatttagtgaaatcatttactcttatattattctgcttcctttttgcttatcttctacaccctgttatttgagggaagaaatatgtgatttatccacacctccaatcccctttaacagcctgtctgccatttggcttcaagaaaagtggctgtgaaggtgagatggagtcgccgaaaagattcaaagcaagtctcagcaagctgccttttacttttagcaaccaagctaacttaaacttgatttagctaaagtaaaacatgattctcagttttgaagaggtggtaaattacagttcatctctgtccatacttacagctaagaacaaatagctcacataatttgcagtcctcctcctccttctcatttgagcaatgaaaaatctgcttaaagaaaaaggaagtattaaatatggtatttatccacaaaatgctcttttggatatcagaagtggtctcctgcataaactagttatgcatttaataagacagctgtacaagctcctttgtgtgtgtgtgcaggaggttcgttttcaggtgttcagcaacttccgctgctagatggtggtgacttgtggctgtcaccaccccttaggtaggtagacgcagccatctacgtactaagaccaattgctggaggagaggtgctgctggggtctggatgtttgtgcatctgttgtatccaaatgctttgggaaaggaagaggagggcacttgctgagagagctgggagcatattttagcttatgggtttagaatctaaacacttctcatcttgctgtttttaatgaacttgcaactctgtctttgtgcaggtgggcacctctgccttgaaaagtcctctgcgaagctttctgggtcttcttgacagaacaactcttttctcttctgtgccacctctacccctttacatgctgtttggggcttttttcacatgattttgcatttattttttatgcatccgtgttccctacaaaactgagttcttcaagggaaacagtttgtgtttgattcatttctagcacagggccagacacagacgaggttctccataaatatttgttgagttgggttaagtaattgctcagcgtttgatggcaacagtgtccacacctgtggctgagacaagtgcttcctcagccccgtccccatgtgttttttacaggcattgcattcccggaccatcttgcatctctctcattaactgtgcccagtggggtttgattcagtggccctgctgagaacagtggattcagatccccgcagtaatagacttggaagtgatttagggtgactatgttaaagacaaatctacaataaagtgagaaaacattttttaaaaatcataagaaggagatcgctgggccaggatctgggatggagggagagtgcagctccgcgagaggcaggtctactcaggcggccccttgcatggcgagggtcttactctctgccctttgcgagggaggcatgggacccaggaagagaagaaagggggttttctgcagatcagagtgatgaataaaatcctagagatcaattgccgaggtcacaatcagatccattcgttagctctaagcttcatggagaccagaaaagggaagatatgctttcatcatctgataaaaagaaacacatcgttttgggtttggttttgttttattttgttgagacagagtctctctctgtcacccaggctggaattcagtggtgtgatctctgcttgctgcaaccttggcctcccaggttcaaactgttctcctacctcagcctcctgagtagctgggactacagacgcgtgtcaccacacctggctaattgttgtatttttagtagagacagagtttctccatgctgtcccggctggtctcgaactcctgccctcaagtgatccggctgcttcagttcccaaagtgctgggattacagatgtgagccaccgtgcccagccagttatcacagtagtttttagcggggagaaaaccaaacctccttttttctgggaaatccaggttggtcctgtgtgtggctgtgccctggagacgctgcatggcctctgccaatcgtttgactactctgggccttgacttcctcagctgcagatgaaagggtggagttcagggacctctaatatccctttcgagtcctgcattctctggtcagacagtatatctagaatccctccggattgaaatcgtgacattggcctcaaacagcaggggccggccgtcccagagcattagcggcaagcattagctatttctttccaggcttgctggttttgtggctttgatgcattcaggacccacagatgctcatcagagcgactgcgctgcccaagtaagcactaaaaccccagccgtcagcaccgaggcaaggctggctgccactgcgagtcagcttcccgcagtaagcggccagcagcagctgccgggctgtcactccagccatgccgacagccacaaacaccaacccagttcccaagcaatcacagggcatccgctgtcagcactaggaagcttctagataaggctgccgctgggttggaagagcgcttgcagaaatgctgtgtgctgcctgaaaaagctcgccctgctctgagaaggagcagggactccttcctgcagacccatccagaaaagagttgcaagatgcagaagcaagagtggctccaggctctcagcgcactggtcactcgacaaattgctttgcagtgaatttgtcttgcaaatcaaggggaggggagttggtttctgcctgcccagtgctctctccccttctcctggattcccatctggccctcaagcactttctccctctctattacccagactggctctgacctagctttctctaataaactcattgacaccgggtgagaagaatccacacagctttggacccttcactgaatggtgtgcaaaatctgcaggaggaggaaacctaatggccagtggtcattttcaggcgtttgcatgaggaaatatttggtgaaccaccccctctcccctacacacacaccctggcaaggctggctgtgctgataggcaagggtgcagggctgccctgacctaaataggaggtaggtaatgttccctttgcagccccccttctcatttctctaacatccaaggcatctgttatatttgctgcatccaaggtccccacataaaagaagcgttggaccccttccattctcctatcatgactttgggtgactttcctctgctagttatggcaaagcaatttgcctaatctgtgaatgggctaatgcactcccactcccaggtagaatacttgtgtttgaacaagaacctcctgaaaatgatgccctgacacaatgggagagctggaattcgaggaacgcagggtggggctgcggagatatttggggacgtgagtcagggaccccgcacatcagacctgcagaaaccaagccctccgtctaggtggtgaggatctgtttcatgaactggagcctgaagtggctctgaggcctcccctggaaaggaacgcaatagaacagaattaatcaaaacgggaggccaggaggaggaggacaggaggggaaaattgctggcggggaaggaggaggacaggaacaaaataaaaaagcaggaggtggagtttgctcactgactaaaatcattttctgtacggagccaagatcgactcatccgttggaattgatattttgctccttcatattgtcagacttatttgtggctccgagtagcactccttgatgtcagcttttgccggaaagtttcaagacctttcagggcaaggatcagaagagcaggaagcatgagagtgatgaataaaacttgaacttggctgccttccataaagcacagtggcagcttcaccagatgcagctggaactttaattggttaaattttaattggctctgctcttgtgggctaagggttgggcaaggaaaatgtgttttgtttgtttgtttgtttgttttttgcttttcctaaagcttaactgtcaggcagccttctttggtcacctttgaaatggtgggatggcaaaggggctattttatgttttacattttatttttatttttgagacagggtctggccctgtcacccagtagcaggatctcagctcactgtagcctcaaactcctgggctcaggtgattctcccacctcagccccctgagtagctgggactataggcacacactaccacacctgtctacttctgtgggcttttttttttcttttgtagagctagggtttcatcatgttgcccaggctggtctcaaaatcctgggctcaagcaaccagcctgcttcagcctcccaaagcgctgcgactacaggtgtaagccactgtactgggccaaaggggctattttaatactgatttttctattgaggaaatcttacagctgggtggttggtggtattcatttctcatatgaccttgcttcagagtttaacatcttaccaaacatatgtctatttctacaagtatttaggatgcactggtgttaccactttgcttttcctggtcactgttgtgaaaattaaccaggggttgaagctacatcattttaattaagtgggctgcctaaagcctggcctcgacatgaatttcaaggtcaccatgggtgttgtgagagcttactgcctaattcacatctgggagtggcgggctagttcttgcccttcctttccatctctgctctgttgtgacctgaggcgtgaaggggaggctgggtggccctgccctgtgccccttccaacctctagacacactccactccttttctccagtgctgtgaacacctcagggctgggaaggggcctgggcccccactgggacatgcagaaagcaccatttgactaaccatgcccttcccgcctctctgctctttacagaatgggttgaatggcttgcatctggcttctaaggaaggccatgtgaaaatggtggttgaacttctgcacaaagaaatcattctagaaacgacaaccaaggtatgtctcacagggagtgggggagctttgcattgaaaattcaagtttgtgagtccttccttagaaaccagtccttcatgagagaactcaggcatgcatctgaatttctcttatccttccaatcactttttagttctctgaatccctgaagctgcctgaaacagaccccatttccagaaagattcagtgggcctttatcctcatcactaggttacgtatctaaaaatagagccctttcctgatggctttatactttctcagggtccttgactcgaactcagtgtccaagggctctggaagcgccaatcaggtgcctggagtcgaatcccagcagacatacttcacgctctgtgacctgggacgagttacttggccactgtgaagcctcagcttctttgtctgtaaaatggagataataatacttagttgcagggttggtatgaaaagtaagtgagatggcatacatcaaatgcctggatgtatttattggatggatgcatttactacttattggatgcatttattgattattggatatattaattgattactgattcctgtagtaaggaatcaataaatactagtgaccatgttgttactgaaggttgtagagaagaatccagatttctttcatttctccttctccagcaagtcttccttgttcagccccaaactgatttcctctcctcgctaacgatctggaacagcattctgtttcatgaggaggcgtttggcatggggcgacgccaggcatccacagtaacgtatttcactccatttcagtagattataaataccagtgactcaacttcaaaatcccagagtcatgaaattgatacatctatagattgcaaaataagtttcattttttacctgacatgcatcttatttatcaaacaagatgcagccagcaattaaaaataaaatgaaacagactgggcgcggtggctcacgcctgtaatcccagcactttgggaggctgaggcgggaggatcacttgaggtcaggagtttgagaccagcttggccaacatggtgaaaccccgtctctactaaaaatacaaaaattagccgggcgtggtggcgggcgcctgtaatcccagctactcaggagactgaggcaggggaatcgcttgaaccctgcctcaagcggaggtggaggttgcagtgagccatgactgcaccactgcactctagcctgggtgacagagtgaaactccatctcaaaaataaataaataaataaataaaacgaaacaaggctggacgtggtggctcatacctctaatcccagcactttgggaggccgaggaggggagatcatctgcggttaggagttcgaaaccagcccagccaacatggcgaaaccccatctttactaaacatacaaaaatcagccagtcgtggtggcacaggcctgtaatcccagctactcgggaagctgaggcaggagaatcgcttgaacccaggaggcggaggttgcggtgagccgagatcgcgccattgcactccagcctgggtgacagagacagactccctctcaaaaataaataaataaaatgaaacaaaaaatcatctccatttgctaactcaagtactgtctccccagttactgttttctcttctcttccctcctctgttcctttcccatgtttttcttctggagttctttccccctagcctcttattttccttttggtatatattacacgtggtctcacacacaacctcaatttcagttccatgcagcaaacagtttgccgcctctcaagcagagaacatagaagaacaatatgtagagaacagatataatttatggttatgaagtgaactaccaaaatattatgaaggtagaatcatctcttgaggtaaaattctgtaattttcatgtcatttcctgaatgtgaaaagatcttattgcacttatgggtaaaataaactgagttgctctttctgactggatacggggtatttttttcccaaattctatgtcaaattccaattgttcccaccctgcttttcgtgtggatgaagggtgagattattttctctgcacactcccacgtacctggctgtgagctgtgtgccatctgacctgccccgcgtgtgccggagcggcgcctgccctggcgtgccttcaagggctgcggaaacacgaggcttcagcgcttcgactgtttccgaatctcctccccaggttgtgattttgcaagtgaacacttggtgtgtcttttttatttttagaaattttctaagccaacgtggctttggaataccatccagagagagggggaaaaaaaggtggaactgaaaccgtgggctggggaagagtcacaacagattggggactgtgatggggctcccaggcagcagaaagatgaaaaaaaaaaaagaagaaaaagagtaaaaagccaaaaccaatttagattcctaaaatgtacttagaaattttaaaagcacaaaacaaacgcattctctccccatcctcctatctccagctcttagagactggagctcagcacctaagctgttaatgaatggggacagctttcatctccactggaaaaaagcctgctctctcacttggggtccctctcccccttccacttgcattcaatcagcacccatgcaaccatcctccctgctctgagctctgtgagcccctgaaaatagagaaattgggtgtttgtggagcaaaatatagctaagtaatttttcctgctcctttgaggccatgttctttcatggtgagggaggggcagagaaaatagaggctcacaaatcccttttcctgtgactcccacaacttaggccaggggccttcttgagcctcataatgtgtgtgtgtagataggggaaaggaggtccacttccagaattttccctgtgttcttattcctcacttatgctaccgttggctcagctggcccgaaccaagatccatagccaggtttccatcactgatgagctccccaaaacagggtgaccttcccctcctcgtggggtaaggaaagctctcatatcattggacttcaggcaggaagggtcagttggaaagaaacctttgacgtgagcctcttgatgtctccatggcctctgtgcctccatgctggcccaggccttctgtgcttatgcccaggaagcatgtggccagtgaatgaatgcacccaggatgcctccttcttttccatgggagcccagaagatgccacttggagctcagcgtcctggtgtctagaaaagtttctggtgccagcagtgctgctccatttggtacagcaggtgccaagcctctcaatggaggctctttggacttctatgaaaaattattaatgagcttccagactttcatatctggcatttattctccaatggatacctgaggaaaaacctttttcttcatcaaatagaacttgaggagaaatcaaaaagacaacttcaggaggcaacagatgggaagtgcctgcctttaaacaaaacaaaacataaacaggctttatgcctttaaaaaaaaaaaaaaaagaaagaaaagacagacagactgggtctcactgtttcccaggctggtcttgaactcctggactcaagcaatcctcccgccttggcctcccaaagtgccaggattaccaatgtgagctgctgcacccagccccaggctttatgcttgaattaccaggcagagtacaagaaacagaactgagctgcttcccagcccccagggcggcctcatggggctgcctccctgacccggggaagcggggtcagcagcggctggggggccacacggctaggccccaggctgctcccttccatctcagtgaggaagcttttcctccaggtgacaggagccactgggcaaggtcagagtccaaagtccctgcttgtcagttcttaagtttcttgaaatggattagttaatgattatgtagtttagtaaaaagaactacatactgtctaaactctaaaaatgaggttgtttgagatctctgctccttaagtagtgcagggacagatgggtccgaccatggacctattttctccactcgccctatttgacagaagcatggagtggaggctgcccgcccctgcccctcaactccctgaatgggggctcaggtgcagggcacccaggggagtccacccccagaggcagtgctgacattgtggtccaggacccccaggggctggcaggagcctggctggaaggctgtgggtatcccgggaacagatggaggctgctggtcctgtctgtgaattgttgtttaatatcaaaaaagaatccagacaagaaaaccggagaatgttaaactcatgttctcaggcccatgcctgtaataccagagtgctgagaggctaagacaggagaccagcctggacaacaaagtgagagcccatctctacaaaaaaatttaaaaattggctgggcacggtggcacacgccttagtccccacctacttgggaggctgaggtgggaggatcgcttgagcccaggagttggaggctgcagtgagttatgatggtgccactgtgctcctgcctgggtgttagagcgagacctccaattctaaaaacaaaataaaacaaaacaaaaactcactttctcagaacctgccttatttctcagtctctgctattggttcttatcttttacaaagtttaaaacaattacgtgcctggttttcctccagtgtttattctctccagtttttctctcctcttggatttggtgaacccttactcattacattttgcttactagtatgttgcatattctttgtatttttcttggccagattgtattccatttattaccccccatttattttctgatttttcttctcttccctacatacatcatagagttgatcttaccctttccttttctgtataatgctttcctcactctcctgcctcccatctctttgtccgctccactgcagcttgtggtctgtgggtatccctgggatggcgtcaaaggtatgggcctgagggacctgctggcctcctttcctggcgctcccaggcctctcagagggcttgttgccttgcagaattgcaggctgagcggagctgcaggtccgcggaaggccagctcgctgacaagccttccagtgtgtgtcctgagggacgccaacgcgctgtctgctggggacaggacgctgcacgcacacagcagattagatgttcagaagttgtgtgttggcggggggtgtttttttctttcagtattatttttcttttataaaaattttttatttttaattattatggatacataatagaaaaaaaggagttcctttgacatggccgcactctccttcaaccgcacatctcagtgtcacctgcccccttcctgcgccactccaatcacaccagccagtgctggtggtcttctttttaaatgtttttctttttatagattgagggggtatgagtgcagctttgttccatggatacattgtgtagtggtgaagcctgggctgttagtgtggccatcacccgaagagtgggcatcccatccaaaggataatttctcattgcccccacctcccaccctctgagtcttcagtgtctctccactctctgtatgtccacgtgtgcacattatgtagctcatacttacgagtgagaacatgcagtatttgactttctgcttctgagttgcttcatgtaagttactggcctccagttccagctgagttgctacggaagacctgatttccttcttttttatggctcttgcagcattgtttgtcatagagaacaggctggatcttcctccctgtactttcagtatgatttcaggatgtgcaatgggtcaagcacacacgtgtgtcctttctaccccttttggccatgaagaaagcccccgggtccctcaagcagcacctgtccacagacctttgctggtcccgtagcgggcccagtgggaaaccgcctctgttcccttcccccatgtgtttcagaaggggaacacggccctgcacatcgctgctctagccgggcaggatgaggtggtccgggagcttgtcaactatggagccaacgtcaacgcccagtcacaggtaatggctctctggtctggactagagggtgttgcctttccacaggtggttcctctttgctgctccctcgtgggtccattggcagccgtgttaacacacacactactgtggggcagggcctagatttctcaggagcatgtctctgagcagtggtgaaggtgtcctttattatttcgcatgcatagaccgcgtgtcctaagcatgacggggttgaattgttttggacctaagccaaatagtatgtccagttgtagcctaggtggagagagaaactgaggactgggggaatgaggtgtgcagtgcagcattgatgaaatcaatgaggagtatgtgagctgaagagactgacctacggtggcgaggggaggcacagcctctgtggccttttgtaataatcccaggacgccagtcaccatgacaatgagtttccttaggaggggtcaggtgggaggaaatggaatgaagagagcgctgtcctccaggtgagaggacgttgtgctggtgtaggcctttcttaaattgcgggtggatgctaatgatgtcctctcttggtttacagaaaggttttacacccctgtacatggcagcacaagagaaccacttggaagtggttaagtttttactggaaaatggagctaaccagaatgtagccacagaagtaagtaccttggaaaaatgtcgtcaccaccagaagtctcccaggtgtacaaccttgcttcaggtgacacctacctgggatgtggcttggggtgcatccatgtcatgatggatgaccttcaggtcgctgcactaatccagagtgctgtcaggttctgcaagggactaatgacaaagtcatgggtcttgaagaaggcccagacacgtaccaaagaaacgacgtcacacttgagggtgtccttcccgctgtggccaatacttgtgactggagggggcaggcgaagcatgcatgtgtatggttggcaagtttgcattgggccttaatgagaaaggctcttgccacaaaaccaccatgcacccttggacaagtctcattagctatggtcctgagtcttgtcattggtgaaatgatgaaattggactagatagagccaaggagtctcttgactcttaactttggatggctcaatgacatgactttgttgtcattccgttttatcagttcctgcggtcctgtgccctttagtatgtccacaactgagggaattaataatagtagctcatggccaagcgcagtggctcatgcctataatccaaccgctttgggaggctgaggtgggaggatcacttgaggccaggaattcaagaccagcctgggcaacacagcaagaccccgtctctacagaaaaagaaaattagctgggtgtggtggtgtgtgccttattcttagctacttgggaagctgaagtgggaggatcacttgagcccaagaggttaaggctgcagtgagccatgattgcaccaccatactccaacctgagtgacagagtgagaccctgtctcaaaaataaaataataataataataatagctcacaattgaattatcagggcctggtgtggactctggcctttggtcggtgttagtaatgttctgccttgtcaaggcactatcctggtaccagcagatggggtgagaaagagagccggcaaagaatctgagcagtcaaaagtttcttaaaacaagtcaaactggaagcaaattataaaggaaaactaaattaatgctaaagaaaaattcggcaggctctgtgagattgcagagaaaggaagtggaggcaggaagggcttcagggaggagatggcatttaggctaaacttggcggatgaagagggctttggtggaggtaggtccctcaggctggggctgctgggagcataagcccgaggggcaagggtgtgtcccgtgtgaagggcggctggcgtcagacgagtcagagcaaagcattttcctcctctggccaggacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaaggtgagggcgaggaggagggaggagccttgggccgcggacgcccgtgggctcagggggcaccgcgcacgcccagcgacttcccaggcaggagaaccgagcgtgcagggcgggcagtgcgcactgagcgccctcaccccaggacgcagaggggcccctggacagccccgctctaaatccctggcagatgcccagaaacgtgctcttggtgagcagcgggggtggttcctgttgctccaggtcatctggaaatgtgtccaggcgggcagggcgggtcaccctggaaccccaggaggcggccttcctgatgttccttcatctctcctccccggctgccccgtagtggagggaggaggcgtgcaggggctggggtgtggagaaagggggtccgggaccttgcacgcctgcgtgcacctgggcacgctctccggtgttcggaggcactgctgatctgctgtctgtaggctgaggctgctggttttcttttagtggaaatggatttactggagttattcaaagtcccctcctgcaccccgcccctcccctcttccaccggccccagatccaccgggttttgtctggaaaacacctgggtggggttaggcctgccttcaggctctggaacagaatgatgacaatggacggaggttgaggcaggaggatggtttgagcccaggaattggagaccagcctggacaacatagtgagaccctgcctctaaaacattttttttaaaattagctgggcatgatggtgttcgcctgtagtcccagctactggggaggctgcggtgggaagattgcttgagcccaggaggtcgaggctgaagtgagctgtgatcacatcacactgcactccagcctgggcaacacagtgagaccctgtctaaatgggaggaaaaaaagaccatagccccattacactttcattcatgaatgaaaatctctttgtcggtgatcactctgacgaacgggcccacagagtctgaggttaacatataattcgggttgctcagggcagacccccagcttttgaatacactgtgccataaagcctctcttgaccccctcaccaaatgttcccacccatcaaaatctcctttgtctgtaaagtcctgttgccccacctgagtttcctgcatcccagggctgattctgagatagaagtaaatcacatataacaagtttctccccctctgttgtgccccagacgggattcacgcccctgcacattgcggctcactacgagaacctcaacgtggcccagttgctcctcaacagaggagccagcgtcaatttcacaccacaggtaaccctggggcacgtgcgccctcactgtccgggggcttggggctggcagttgctcctgcctcggcaccatgggtttcatcccagtggcagaagtgcctgtgggttaaacagccctgctgtctggtcgggctccttgctggcaggtttctgatcatctaccccccagtttccacctgctttgtcttgagaaaaccctaaactccatttgcccatcctaaaaatgggaaacctggagggcagagagtgatttccatataactgactttcctgcagtctgttatgttgactctgggaggcatgggcttgggtggtgtggtgggatgacccatcctgttggcaggtcctttcaggttttaaaatgtcttaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgagactccgtctcaaaaaaaaaaaaaaataaaaaataaaaaaaaataaaatatcttaggccagaaatgccctgacaacgctgttgcaggcctggggactgggggctggggacaaggggagcgggtgcacagcagctgcattccagggaaggatgacgcgccctgaccgtcctgcttcctcccttcagaacggcatcacgccactgcacatcgcctcccgcaggggcaacgtgatcatggtgcggctgctgctggatcggggagcccagatagaaaccaagaccaaggtgggtgccagcaggtgctgtagccaggcagggggagggaggtcccccctcacaagcctcacccagagcagcgggcccttggtgacctagttagggatgcaccaccagcctcccggagccgcctgcagcagtattctgggcagtgccgcgtgcagtgggaggcaatagtaaaactgtgctgaggtcgagctggtgcttgaggaaacgtcagcacttgcgtgggctgggatgatgccataggcagtcttctctccaaatggcctctgatagctgccttttgggctttctgtttttgactctgtcttttaaaggacgaattgacacctctccactgtgcagctcgaaatgggcacgtgcgaatctcagagatcctgctggaccacggggcaccaatccaagccaaaaccaaggtgtgtacttccttcctgtcaggcgcattttctagacagggctccaggtccaacagacctggcatcaaatcctatttctgtaaaacagagatgctaatactactagatgagatagcacctttgacatttattacaaggcctatcacgtaggagactctcagtgtagctctaatgcctaactagatcagggtcggcaaactttttatctaaaggaccaggtatgagacaattttaggctttgcaggccgtggtccctgttgcaatgattcaacactgccaacgtagcagaaaagcagccacaggcaatatgcaaactagggcccgtgttccaataaaacgttattgacaaacactggtggcagggcagatttgactcacaggttgtgtagttcgcctactactgctctagatcaatccctatgtctctcttcctagctccagaaaagacaggcactaagtactctgagaagtcttcagagcctgggccagactgaagcgaagttaaaaagaaaagaacacagttcttctcaggttccattacgggccagagaaaaggcccgttacgtggctctgacataaggactcgagtcttcaaggggtgaaagctgtcagccacactgctgcctgtgcctgctctgggccctctgccccgtgaattgagctgtgtcagagcagagcaaggcaaaagccaggcccactcacagctacccaggaggtttcccacgagcagttctgtcataaaatgatggcttagaccatacagtgaaagctgatttattcccgacacattatcatgttctgttctgtagagctgtcgttaatttgggtcatgattcatagtccccacactggttcttgggtgtgtctgtgtgtgctgttgcatgagggtgtcctctactaaagcagtttctcatttagccctccatccttggctgatttgccgtgtgactatgaacgtgtgtcttgccctctctgtgtttcagtttcctcatctggagagcccccaccctctctcctaggattattgggatgaccatgtgagataatgtcttcaaaagctatctaaaagtaaaactcctcagctaaatgaaagtagaattgctactatcagttaaattattagaaaattcccaacatttttccaggagtgctgtatttaaacataatacatggccagaagttaagattttttgttttattatccagatcattagaatggggctgaaaagaatgcttatgaaaattccttactgagaatatgtgacttttcaattgggaactatcgtacaacctttctgaaatgcaagtgtaactaactgagttagctcagtccaccttaacaaagaaccacatgctgagtggcttaaacaacagaaacttactgtctcacacttccagaagctggagggtcaagatcaaggtgtcagcagggttggttctttttttttttttttttttttttttttttgagatgaagtctcactcagtcacccaggctggagtgcagcagtgtgatctctactcactgcaacctccgcctcacaggttcaatcgattctcgtgcctcagcttcccgagtagctgggattgcaggcaaatgccaccacgcctggcctatttttgtatttttagtagagatggggattcaccatgttagccaggctggtctcgaactcctggcctcaagtgatctgcccacctttgcttcccaaagtgcgggaattacaggggtgagctacagtgcctggcagggttgattccttctgaggctgtgagggaacatcttttccaggtctctccccgagcttctggtggtttgggcacaatctttggtttccttggcttatagggcatcatgctgacctctgccttcatcttcatgtgacattttcctgctgtgcaggtgcccaaatctccctgtttctaaggacgccagtcatagattagaactcacactaatgacctcattttagcttattatatccccgaagatcctgtttccaaacaaggtcacattctgaggtcctgggggttaagactgcagcatgtgaattttgtgggacctaattcagcctgtaacactaacatctgctgtcatggaacctgatttgcatcttccttgatgaaaatcctctcatttccactttctaaaagctgaagtcccaggtcctgagctcctagcctttcttggcgcagctccagcctcctctccagcctgactccatgcttggaatcacctcaccccggactgtcgaactgcatggaggcccctgggttcccctagggtagctgcctctgtgatgttgcacttgctgctccctaggatgttcttcccctttggtcctcctggtgaacttccattcagctcctttcaagtcctagctcaggcctcacctcctccctcccagtgcccctccttcatcagggacgccatctgtttgtgcacaactctgtgctttgatcatcccacttcagggcgctgaaagacaacaccatgtctgtctacaagcttccttgggtcaggggttatgtctgttctcttctgtttccccagagcttaacccataccaggtgcacattaatcacttgatagatatgtgttgaattaatgtctaagtgaatgaatgagtctcctctctcttttatgttttttaaacaaattgctgtttgagaaatgagtatccttaacagaattttctttaactgaactgcatttgatagggacaaggaacagagggatttagatccaagttctattttatcataattcattcattcattcattcattcaaaatcacataatttagggaccatgatgtgtgttacatgcatgtatttggcactgtggggcatttaaggagaaatattaggctaagtcactgatcttaagaggcgtataagtaaagagaagagatacactcccctaaaaagttagctatggatataattgggcaaatatgagaataaggtctgagcgcatggtgcagataaggaaagcccacaggagtctagagtggtcagggaaggctttctggaagaggtgggtctgctggacatggctttgaaggtttggccaggtggaaaggagaatgtctgtggtcagagaccggcaggagcgtggaggccagggtgagccaagctccctccagagacttgtggaaacattgtgtagggaagaagtagggagtgacgttggaatcgtcctgaatctccatgctcggtccccagaagactttgtgattgcttgtgttttcctctttacccagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctggtgagtgggggtgctgctggagaaggtgcagagtggcagggcaggctgggggcaggagcagagaggcatggctgggcctgtgggaagggcggcaggtgcccggagctccccagattcgaggcctgagcagtggggtgtgacagcactggatggtgggggcctggtgtgcacccctcctgcaccctccactgcacacccacctgggtatcgacccctgccccggtgaccaggccgaggtcagggatgagtttgggcccaggagaccggactcaggaagcatcctgcatggtaggtatgcgggcttggggcatctctccagtggagccaggcctggagctgagtgattccttagaggctgcgtggctttctgagctgctttggggatgaatgagatggccagagctgagcatccttcgtccacagaggggcttgtagttctcatggcactcgtgtaaagggaagctcaggcccagagcaaatccctcctgtggttcctctgcctccttcccaggacaggggctcccagggagtctggggatccagcagggctgtagctttgcactaagcatgcctgtaaccacatctcctctctgcctcttcccaaggcagcagaactgaggggcaggatatcctccagggatggcagaggatggctcattcattcactcattcactcactcgctcaaaaaagctttcactgagcagtgcccacaggccacgtactgttataggggagttgggatttcccagcctcaggactgttgacatttggggtcgatatttgtggtcttgtgtgttgtaggatgtttagcagcgtccctggcctctacccactaagcactcatagctctccttccctagctgacaataaaaaatgtccccagacattgccacatgttttgggggtgaggtgcaaacgatacccccccaccaccacctcccgtgtttgagaaccactgccttaagtggataaaccactgaaaaaaacagacaaaaacaaatacacatttctgcccttcagagtttacattcagagtatatcacactttaaagcagaaatccatttcactaaaaatgatcagtggtttcagggaagagggaacatgatttgcttcacaaaagtactcttttattgtaaatttacccttagggggctttaaatggcaggatcttttagtgcatccaaaatatgaataaatttttaaaaaaggtttataaacaacatgttcaggaacatatctagtgcatcaagtgagagccacctgtctcttacatgatttgcattaattgacattataagactaatcaattggcattaattcgttgattggtctatgggcatctgctggtggcctgggcagcagctgccttttagagcagccaggtggtcttctgggcgttccttgggcccgtgtgtaagctcctgcttgtctgtctccctttgtgtgggctgcagaatggctttacccccttacacatcgcctgcaaaaagaaccacgtccgtgtcatggagctgctgctgaagacgggagcctcgatcgacgcggtcaccgaggtaggagagactgcagaggagcctgggggcaggcctgtggtctcccccgacccaccttctccaagagtcgctctttgtagctttgtatggctgcaggggtgtgtgtgtctgcaagtctggactgctggaaggaatgaatcaggggtgactaagacaagggaacatgagtcaagtctcatggagccttccaagatcagacacaatttttgcaagttgtaagagtgggcacgacttgcccacagtaatttttttctccaaccattttcttggaagcaaacccacctcatatagctcccttttcttggaaaatcatttgtgaaagcgttagatactgtcaggttctctcttcttcaggggagcggaaagactcccacttatcggactctgcctttgtctgtttcagtctggcctgacacctctccacgtggcctccttcatggggcaccttcccatcgtgaagaacctcctgcagcggggggcgtcgcccaacgtctccaacgtggtaagccctcaggcaggcaggggcttgctcccctagaccaagagctcagagggcagctttcaccagtgctcccagtcctactctctggggacagagctacgattcccagaacagccaatgcttcagactgggggaggacatccctgtgtactgacgctttctggattaaatttctcacacatccgtaaaccttggaggctttgttttggacaataattttggaacgtctgtaagtgttcactgggaatacatttacatttttgaatattcattagctctggggtttacttttaagtgtacctagaatacacagacacacacataaactcatatacacgcatgcacctgcacgtatgtgcacacacacacatacacacatacatgcgcatgcacacatgcacacataccaggctaaagagctgcctgctggggcaactccacctcttggacaaaaacccaccaagccactccagactgcacttcctagctctgtgtgtgccgttttggacagcaggcatgtatgaacagttctataattttgttattttatagaaagtggagaccccgctacacatggcagccagagccgggcacacggaagtggccaaatatttactccagaacaaagccaaagtcaatgccaaggccaaggtgagtagtgaaggcaggaagggaagggtttcagatgtgagcagttccagcactgtgcagagaacccatcctcattccaggcggggctgcagtgctgtggcctggggatcacttttcatcctgatcaggtcactctgagcgcccagattctgctttgcagggggtttgagaagaccagggatatttctgcatgagagccacatttctttaaaataaggaaagtccaaggtgcgtggctggcctgagtatgtcctgggctaacgatgacagttgccatgtaaggaggggggcaacgttttaaagaaagcattgccagcaaaaatcaggcaagaattacttgatctaaaactggagagttcccccttgctgtaaacacattttgcgggggttggaggagtagacagtgagaagagctgtggagtttgccagttgctcactcggccaacagcaggcttcctaaccacaggccacgatgggttctccttagagtcaggcctgtgatttgtgtttggggccctcgagggaagcctccagctgggccccatgagacctggcccaggcagcccgacagcagcattcagaaacaggaagtgggggggtgtgggtggaaaagtcctcattctctgtcagcagttgagactcccctgaccccagcacagagaaaatcaaactagagttcaagcagaaagacaagcgcatccactcagaaaggatgtgggagacggatgagcagccacactgcattgagtgccttttatgcaccaaacgcagaaaccatgtacattatcagcttgatcccagctgagccctagcaagtagacgttattattcccattttacagatgggagggctgggcctttgggaaataaggtagaaataacagctcacttgaagaactgttgtaaggattcagtaggatacagcatattggttcctgtaactcagagacttgattcgaatcctgactcttcatcttcttagctgtgtgaccttgagaaggtcacttgccctctctgggccctgccttgcttctctgtaagatgaaaagttggatttggtaacattagcgtttcttcttctttgttttcccttcggggtccaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaaggtacagcctcccgcctcgtggtctaaggaagcaacaggctcactcagccaggcctggagctcggaggggaattcctgcctggttctctttgtcacctcaatgatgctgcaagcagctggaagggtcgtcacactcagggctggccaccacctgcaagccgatgtgtctccatccttccccaaaacaggaagtcaaccacagcttctcacacacccagccagccttcatacatttatcatggcacaattattagtcgaaacctgctttgggcaagtcacaaacaggttctggggatatgaaaaggattaagactcataccctgccctcagctagccagcaatcaactaccactgtgaggtggttgagaccctcttgccagaggagtgtggaccgtaagtgcagggatgcctgccaagtcctgaggtcttcggcctcccagagggctcaaaaatggctgtgcctttgctttcattggcctctccatgccagcggaggtgcagcctcctttgctgtgggccctttctccagggaggacagccctggggccccaaggtcctgacagcctgtttctcctcagaaaggatttacccctctgcacgtggcggccaagtacgggaaggtgcgggtggcagagctgctgctggagcgggacgcacacccgaatgctgccggaaaagtgagtttgaaccctgccctcccctgcagctctcaggttagaggcaaggacagaggatggacatcagcacttgcagattccatctcttgcctgtgttgttcatcttttttttctttgagacagggtctcgctctgttgcccaggctggagtgcagtggtgccatcacaactcactacaattttgactcctgggctcaagccatcctcgagtgtcagtctcctgagtagctgggactacaagcagttgccaccgtgcccggctaacttaaaaaaacaattatagagacagggtctcactatgttgcccaggctggtctcgaactctgggctcaggtgatcttccctcttcagcctcccatagctctgggattacaggtgtgagccactgcacccggcctgtttatatttccatgggtagccatcgagagagaatggcctttggaaagactggcctttctgtcaaaggccttatccttttggaaagacccgatggccttctccgggcaagtgtattgatctcactgcccacgttcccccctgttcccacagggctctgggtcctgccgatgacattctgtcatgactccaagttaagactggcctgggaaagattttaaacaggattttactgtataaaataggtgctcccatgcctaaagggagtcctgggagaaagtccgtgggagtgacagccggcctcttttgtctttgtcccctgcagaatggcctgacccccctgcacgtggccgtccatcacaacaacctggacatcgtcaagctgctgcttccccggggcggctccccgcacagccctgcctgggtaaggcccgcccctctccccagctgcccctggagagcaggtcacctgctaccttccagtccctcagggaggggggtttccacagcagcccaagggttttgcgttctgttgctatttttacctcagaaatcacgcctcactttcccacatgttacctgccctgtaatcacgctattcagggcccaggagtgggatgggaagtgggtaacaattcccagccaggggttacctcgcagaggcagaacttgttttatacaacaaatgtgtccccaagcagttgcacgtcagctgggttttgtaaactgactgtcagaggtcagtgtggataaaaatccctggggagtggtgagcccgtttctagcattgctagattctgactccgtgggactgtgcagtgtggcctggaagcctcatttttaacctactctctgcatggttccaaggctggggccacagcgaccgtactttgagaaatcctcagggctgctggcgagcttgctggaacctggaaacaagagacctctttaaaatgagaatgatcatctccaaattcatttgtctctgagatcagacttttagatagtggcatttttgtagggaggctcacctgaatgtgagacacattggcccagcctcacaccagcttcggaggcgagctgctcagagcagcaggttccgtgacccttgagggaatcagaggagggagcagatgggttgcttctggaagaccccacggggttgggtagtacaaggataaagctggaaggaccatttttgggaacaggctgcctgctgtgggaaggcgaggctgtgtagggataggcaccgcgggactggtggccagcggggagaaggggagaggagagggagcggggccaggaagacaaaagccacacgcagtacccgcactctatggggcagccaggcgcacgggaaacaggataatttatgggagatccgtcatgtggcaggcatccaagtgctgcagagaaggagcctcggggtgggaccccatgtgactccagccaacacctgctggcttagggcctccgcagcccaggcagggagcgtcagtgccagtgcagggcttcggcgcgttctccctccctggacagacacgtgtccccatcttgcagcatcgctcttctacagacgccggctcccgacagctgtctcctcctgtccctgctgcagtgagtcccacgtcgctgtgcagagggagcacacggccccgctgcgatgtcgacttactcctgcctctaaaaataaaaacctggactcccctcctcctcactcccctacttatataaaaggaacgggagccaggttcattatatttaaagataactaaatccaagcacaaaccctgtacagatgggctttgtttccatggcaaaaaatagtttccaaagtagtctggcaattttgtagaatttcacatgcaaatctctctgcacccaaaccaaaccctcccctttctaattttgatgctaatgttgtttgaacatttgggcagagctccctccgtgtgcattccttaggatgagctcatttccttgggaaagaagagccttttgcgggcacacattcctccctcccctctccgtgactttccagcctagttgtccttgtccttgtcacctgcagaagttcatttgttcattttagttctggtttaggggaagctcagaggggcagtccgtgttctgagagtcacagtggcacttgtatctcaattttaaccagaggtttacctggtagcctgagccatgtccagggcaggcctacccttgggcaggacagggggctggccttgccagtgtggacatcgctgcttcccaggtggcctgggattcctgaggatacatccatgaacacactgcagattgctcaagtgatggacccttgtacattaaaagatggcctaatagggccgggcacggtggctcaagcctgtaatcccagcactttgggaggccgagacaggcagattgcttgaggtcaggagttcaagaccatcctggccaacatggtgaaaccccgtctctactaaaaatacaaaaattagccgggcatggcagcgtgcacctgtaatcccagctacttgggaggctgaggcaggagaatcgcttgaacccgggaggcagagattgcggcgagccaaggtctcaccactgcactccagcctgggcaagagagcgagactctgtctaaaaaaaaaaaagatggcctaataatcattgctctcatgtagttattaatggaaaaaccaaactccataaagtcttttggaggtttactctgagccaacgtgataaccatggccctgggcaacacagcatcaagaggtcctgagaaagtgtgtctgaggcggcttacagtttggttttttatatttagagaggcaggagttacaggcaaagacgtaaatcaatacatggaaggtatatattgacaaaaatacctagaaagtcccagaggttataggcagattccgagattctttaatttgcaattggttaaaggagtaaagctttatctaaaagtttggaatcagcagaaaagcatgaagttgagagaagggtctgttcaccagggtcctgggccgagtgacctccagggggcatgtgactcagcccttgcctactgtggccttgggtcctgttgataatttggtgtcttgtcacaaagagtccctttggttagtcttatgatctcttttaacatgaatgccggtcagttgcgcctaaactccgaaagggagtgggtatagcaaggcgtgtccaacctcccttccttcgtggctgggaattcagtttttaaggtttttctgggatctctttggcctagatgggatctgtgtggggcttagggttttatttttcatttacatagtgaaaatcttctctgggccagcgctgactggtgctccgtgtctaatcgtggggaggcttagctctgttttgagccgaccctgcatctcaggctggatctgcggcatcgcaccccattcctttgctctcttttaatacagtgcaaaaatcatgttgtttaattaaacttattataatccaaatgccgatcttgttacatgaacacaacctacgaagaacaatttaatgttttctcataacataatcaaattaaaaaggaagaatactagaaaggattatctcatgtcattcttcaaagaaaatgatttttcaatttaattcaattccttgggtaagtctcaacttttcgtttcaccacaaaagccacctatgggcccaccttgctgagctttccctgtacccagggctttgactgccttggccagcccctttctttccctttcctcttcctgaccagtgatcctggcagaatcagaaatgttggtttccacagtaagagagtggctggcagggagaactcagtcctcagccagaggaatgctggccgaggtggggaaatctcgtgccctgagacagatcccacgttgggcagccatctgctatgggcctgggtgggcgcatgtccaggacgtcctccagcctggcattgcccttaaccctgagtgccctagggccttgctactgaaagtgtgatccctggactagcattgtcagcatcatctgggggcttgctagaaatgcacaatctcgggccctccctagcgcctctgaatcagacactgcattttaacaaggtcccaagggatttgtgtacacatcagagtttgagaaccactgttctagctggaattacctgggctgtgcaatcagaagttcaaggttgggttatctgttgttctgcttactacgtgacattagataaggtgcttaaccttacagagaattggcctctttctccacacaataggataataaaaatgcctgccctagtgaccttatgtggttttaatgaagcgcaaaaaaaatgcaggtgaaagtggttttcggcagtgatgagcaaaggtgcccacctgggaactgtctcttgcctgcagggagataaggagtgtgctccagaatgtaaacccatgcgctgcttccttcactgagacagtcttgctatcaataataataataaaaacaaaaattggctgaataaacagtgcacagtgacatcattgatttacttttgaggcaagcttcttcatctcattgtgcaattataatgtcttgcaaaccagtgcactgcaaaaccatgacacacaggtgcattactttttaaaatttttatgtgtagagacagggtcttactctgctccaggccatagtgcagtggtacgatcagagctcactgcagcctccaactccttagctcaagccatcttcccacctcagcttcctgagtagctacagcatgcaccaccatgcccagttaatttttcactttttttgtagagatagggtctagctatgttgcccaggctggtctcaaactcctggcctcaagtgatcctcacacctcagcctcccaaagtgttgggaatacaggcatgaacactgtgccctgccaactttttatatcttaattttggaacataccttcacgtatagtatcacgtttgatccacctaacaacttcgagaaatgaacaagatagatgctattatccacttttcatgacttaaaagatacagaaggaagtctaggtcatggaacatcttgccctgggtcacacaggtagttaacagtggagtgaggactgtcccacatcctcaagtcccttgccaggtgcatgtcccttaaaccaccctgcctaatgccggcaaggcccagagggcagcacttggcccagttgcactgggaaagaaaaggggctgatgtttctttttctttatgaaatatttggggtttttggctcttattgcaggaagcaagaaatgagaatctttcatttccttacccagccttcctgttattctcttcctgtccagcagtttgtcaaagcataacagaaaacagatggtgaaaaaagatggacatatagaggctatgcaagcctgaggagctgtctccaaatcaaatggattttgtttgtttgtttgtttgtttacctaaattgctcctgggtgatgccagccctgctcactgggtgtccagccggccaagaaccagactcagcccctgcttgtgtgttgatattgtcagctcagcattcctgtaaccaggctctgggcggcttcttctgtttcagaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaaggtaggcatggtgtcttcggatctgccctggagtgctggataacaacgtgtggtgtcttcatattgagcatctatgtgtgcccaggttctgagttaggggtgtgtgtgtgtaatccttggaacagccctgcgtacatttcaccttcattttataaatgaataaacagagtcagaaaggttgcttattcccaaggtggcaggattctgagcctttctgatgccaaagcctttgccgatctttctaaacagattgacctaaggatctgcagaaagatcaatattaaaatccataataaactttcccaaatataggccggtgcctaccttcaggagtgcattctgtcatttgggactaaatattctatgttccgtgggggaaagatatttttaaaaacactgacctatacactaggagttctcactccagcaacaataggtgtgtgaggataaagccttctaaaattgcgcacacatctggggaggaagcgcgcgtgagcagttttctgggtgaagcattcataatgtttctcagcttctcaaaggaatgtgtgacccaaaaaaaaagactaaaaatcacttcttttttaaataacagttttatcgaaatataattcacctagaagtcaccctttcaaactctacaattcaatgttttttagtatttttacagaattcagcagcctatgatctaactctagaacactttcatcactccgaaaggaaacctcgtacccgttagcagtcacttctcatttcccccagagcccccggtccctcacaactgcaaatctttcagtctctaggaatttgcctgttctggacatttcatatacgtggaaccatgcaatgtgaagaaccacttctttgatgataaattcacatagcacacattcagaaaggcaagcattttcagggcaacttaagatttcttaaaaacctatagattttgtacaaaatctggcacattttgtacaaaatctggcacattttttacaaatttgaacaattgacccccaatgagcgaaccattctggtaggaccattatattcattatatctcatggcattctgggttccttcactgccccacttaatgtgagctttgcaaggagaccgtaaggtgactggaaacccactctgtcatccgcacgccgccctcacgaggcagattattggtgttagctcaagaatgaggcagagcgcccgcctgagaggctgacacagtcactcctcaaccgagggctgttctcattggagccacccccgcctgcctgcaggaggggcccacctgctttggctgcagcagtgtgtggtggggcatcatgactgcccacaagcctctgggcagcctgcggggtgtgcagaaggcagaggagggcaagtggagtcctgtagaggggacacggtctgtgcctgcagagaaatccgttttgttggtcccacgctagcaaagtgtattgaggcaaagtccaggggagagaagacttttctgacattttcatgtgggtgcccacatatcaaacaacatctctgataccttactgccttcctgacgaagctgtgatgccacctgcaagaatatggtccgttcaatcctggcgggatgctctgccctcttgaccgtgccagcactggctgtgcagtgataacagtatggtacattatttatttatttatttaagatggagtcttgctctgtcacctaggctgaagtgcagtagtgcaatcttggctcactgcaacctctgcctcccaggttcaagtgattctcctgcctcagccacccaagtagctgggattacaggcatgagccaccacgccctgcttatttttgtatttttagtaaagatggaggtctcaccatgttggccaggctggtctcgaactcctgacctcaggtgatccacctgcctcggccttccaaagtgctgggatgacaggcatgagccgccgcgcccagccatttaaacagcactgtgtgcctctcaatgtgcttcacctgtgctttctccagcgctcctcaccttgcccctgagatggatccatgataacccctattgtctagattaggaaaccaaggctacagggctctgaaattcaccatggaaatggggcattctttactgggaagtccataaagcaccaacgatgggaaagtgccataaagttcatctagatcagaagtcagcaaactatgggcccgtgggccaaatctggtccaccacttgtttgtgtaaataaagttttattgaaacacagccatgcccattcatttaaatgttagtcatatagagacatggccaaaaatattgatgatctggcccttaacagcaaaagttgccaacccctggtctagtgtaaccaccttactttttagataaggacattggggcccagaacaggaagagctttgcctggagccaaataactagttggtgactgcaaagttagcttcagctcccagacctcagagctctttacttgtggcctggaattctttacttgatagaaggtgatgaacgtctttttctttgcagagcggactcactcccctccatctggtagcacaagaaggccacgttccagtggcagatgtgctgatcaaacacggcgtcatggtggacgccaccacccgggtaaggcaggcagccggaacttcagtctgtgtggactccttgctcacacttcagaattgaatcttccacagagctttgaaaccccaaagacccagtgggacattcttctctgccacttcctagggctggcagtggagtttgaaaacactactcctaattacctgactttcccattggggatttttttaaagtttgctagacctttgagcctctgcagtgagaaagtggggcgaatgtttaatcatgactctaagacctgtctaacatgagtagttagcatgtcaaaatgtcaagtttccccagatccacacaaaagcttagctccttttcttccagcacttggttaaatccagttcaactttctttgaacttctggtgtgtgcaaggagctatgtgaatggaatctgccgtcgaggtgtctgcagtttggtgtggaggtgattgctagggacaggaaggaagagcataatttgatatttactcttaagagaggagctgggagcacagagtgcagagagggtgttttcagttggtgcgaggaggtgggcttcatggaagaagccacattttgtttcttttccccacaagggaaccatattaaaaggaagggacagtgacagtaccaggagctcccgccccctccagagtagcacagaaatgccggcaacaatgttatgctgaagtcaccctgagaaaagtctggaaattgtgttttgtctccaactgcctgcagcttccacagcaatctgcttaaaatccacgaatgttctggatctttgaggcttcacttgcgggccccgtttagtcttttggggtcctgcacagagagaccctgtcctgtgggttagaatggccttgaggatccaaaagccatcccattatggggaggatctgtgcttgggtggtctctggaatctggcaccagcttcccgggacacttgggaccaaggagctcagagggccttggcctgtcggcccaaaattcaggaaggcattaccacaaaattcagcaggacagactccttgaacagcccagactcacatgagcgaatgtcccaagcccttgcatttcaataagcaatgaccagttctcataaattccattacaccacagtcacttggacagccttttgggggtttttcaatgggatttcagctttctaatggaaaaaacctgttgtcattggagtgaccatgactccacatccccatctgccctcatctcagcacccttcccaggcctgaaggctgtttcttccttcttgaaatagctcccctgggattctgtgatgctggtctctcaaggtttccctcctcttttctgcctctgcctcactccttcggccccacttttcaccctccactttattctgggggacctcactcacctccaaagctctcagatctcccatgcactgacgaccccagcatagccctcttctcgcggttcagtgtccattttccagttgcccgcttgacgtctccccttgggtctcccacaagcatctcagcctggtggtctctgcccagcagcagccattcagcttgtcaatgtcagccttcaaggggctccctgtccgttctctctttgaatcagctgctttgggaaggatttcatgtgatgcccagctcaggacagctccggtcactccttctcatctgcttttcagatgggctacactcccctccatgtggccagtcactatggaaacatcaagctggtgaagtttctgctgcagcaccaggcagatgtcaatgccaagaccaaggtacaggggtgccccagccccgactcctgcactgacccttctccatgccacatcagggtaaagccagagctgctctgggagcactagggttttgaccatggaccctgaaggaagaaagggggaaaatgcatttcattaatgtcccacttcgaagatgggcaggcactatcatgtgtaggcaggtctctgtctagtggctggctaaccctgcctaaatgtctgctcactttgcagctaggatacagccccctgcaccaggcagcccagcagggacacacagacatcgtgactctgcttctgaaaaacggtgcttccccaaacgaggtcagctcggtgagtacactctctctcctgagtttagaaaactgctccccatggcagcagccctgtgtgaactcccctaaccgtagaggttaatgcacgtgtctagggcctggacggggccgcagcaccctaaagccacagctaccttgggtaccctggggatggggtgctgtgatcagttcctctttctggtgaattgatcgttttccttttaagcaccatttaccctcctcttttatgtttattaaaacattcttaagtgtgagtgcagtggcttacacctgtaatcacagcactttgggaggctaaggtgggaggattgcttgagggcaggagttcaagaccagcgtgggcaacatagtgagtgcctgaatctacaaaaaaaaatttttttaattatgtgggtgtggtgatacgtattagctgtagtcccagctaattgggaggctgaagtgggaggatagcctgagtccgggaggtcaaggctgcagtgagctgtgattgcgcccctgcagttcagtgtccattttccagttgcccacttgacatccagcctggaagacagagcaagaccttgtctcttaaaaaaaaaaaagtatatatatatatatatatatatatatatatatatatatatatatacacacacacacacacacacacatatacatatatatatatgcacacacacacatacataccacatatataaatacttgttgaaacccattctaaaatatgtgaaactgttttcagtatggtacaactgaacataattaaatgtcctgggtggttcctgatctttcagggctcaaggttatctttagtgacatcagcaatcatcgttcggtgtgagcttcttcatctgaccatgtggaagttctgtgaaattatctccgtgtctgcttctatctctgaaataatgtggacccttggctgggtgcagtggctcatgcctgtaatcccagcaccttgggaagccaaggcaggtggatcacttgaggtcaggagttcgagaccagcctggccaacactccagggcaaaaccctgtctctactaaaaatacaaaaaaaaaaattagctgagtgaggtgacaggcacctgtagtcccagctactcgggaggctgaggcacaagaaccacttgactccaggaggcagaggttacagtgagcctagatcacgccactgcactccagcttgggtgacagagtgaactctgtctcacacacacacacaaaagtggactcgattgtagatggggttgcagaaattgcaactgcagctgggcttgaatctgaacggagcccaaggcacatcctagaagtagagaagtcaaaagaaaaatcaagcctcagtatccatttatgatcacgtagctcttcctctttgaatcaaagtagaaaatatgcccttgctgtatttctggtgatttgtgatttccgagtattctgattagagttcattgaagtatatggattaattcaactattttaataccccatcactgacacccaagaacagactttgggagcagcaagcagccttcctctgtcctcatcttcctaaaattgcatctggcaacttcctgacctccttcccagtgggttcccacttagcagagcctgacttctccttgggagatttcctctgctgggttgcaaggccccacacttgacgctgcagatcgaaagcaccgctgccctccctcctcccacacccgtctctgtgggtgctgctgctaacacacatctaggcacacacacgtgcagggatctctttctgggccccacggtgacgtctgtccactcaggtcctcctgaacaactagaaggtgaactcgatctgtgtctagggagccagccccgcctcctagactccatcccctgtctgactgcacccgggctgctctttccccaggatggaaccacacctctggccatagccaagcgcttgggctacatttctgtcaccgacgtgctcaaggtcgtcacggatgaaaccagtttcgtggtatgtctgcctctcccccgcacccaccccagacacactcagcctggcgcacaggcgtgcctggggttactctggaagtggggtgcgttctggggctccgggacgcgggtcggaggcgccgcgcccgacgggtgggagcttgtcctccttccagcggggctgtgctgccacctagcggcccgaggactaggggcgggaccagctttccgggcagcagtggagtggatggggtttggggagatgggaagccagttttcccgggtcccgtccccgtggttcctgcccggcagcttccaggctgagcgcctcctccgtctgtttttcttcatttgtgggaaaccccacaggcatgaccagggaaccgctgggctggtaaaaaatgtgtgcggctctagtttgggttgaattatctgctttttctcgttttagttagtcagtgataagcatcgaatgagtttccctgagacagttgatgagatcctggatgtctcggaagatgaaggtaacgttggggtaaagagctcaggctggtggggacagaggggctccgggcaccctccaagggggcttcctgccacctgccggctttgtccccttacaacacgcccaagcactatagatggacactgaaactggggagacctggtttttataactgttgtctactatcaaaaatactgctctattaatacttaggtgagggaacattgactaaatttaaaatcccatgaagtttcaaaaacacatgtatgtttgcatagattatggatgtgtatgaaatcggagcgtggttctactgagatcaagtctccgcaccatgaggaactgtaataaaattctgcctggttctttctttgtgctttgaacgaatactaagtggattattcaaaatctgtgagcatgccttttaagctgcacttctgaccacatagtgggtcaataggttttgggttatttctgtgattatgaaattactatagtctggctgggtgcctgggttcatgcctgtaatcccagaactttgggcagccgaggttggaggattgcttgaggctaggagttcaagaccagcctgggcaatatagggagacccccgtctctccaaaaaattagaactaaaaattagcagggtgtggtggtgcacatctgtagtcccagctactccagaggctgaggtgggaggattgcttgagtccaggagcttgaggctgcagtgagctgtaatcaccccactgcactccagccagggtgacagagcaagaccctgtctctaaaagaaaaagaaagaaattactatagtatcagcttgtatgaactacagaatgcttctagtatttttcctacccccagcaaaccttatttcatcactaattagatggggatgttgagtagtaggatcctcaactctgaggatgttgaatagtggggtgggctggatcagctcagtggtcccttccatctggataatttcatggttgtataactttgtcaactagagaagcagagcttctggtgctcctttggataatatatgcctctcgctttaactgccttcaatgtggtccttctttcaattctgctctcctttgctttccaggaactgctcatataactataatgggtatgaaatgctttctgtttactgtggtcttttctcactagagtgcatttcaccctaagcaaccctgatgctcactaatccattcctgctttccatcttcctctgacagctaataagctggagccaggagctcagctaaaccagggaattcacacccatgagacccatgcctggcgggcacctcctgcctgtccatctttgtgtctgtgcccatgccaccgtgtttatgatcataaccgcatgagctgttgttcttccattccatcagctccagatcacaagccatggtgctcactcctgggtggcaatgaatgacccctcaaggtcgagggccggggctccagctccagttgaagctaggagagagaaacaaagaggcagtcagaggtgtaggcagccgattgacccgtagtttgaaactctttgtgataggctttggaagtaatgaggttttggctgccattgttacaaaaaattctccagccctttgaaatgagtgggtccagttccactgtaatttattcttctgttggtgtggagtggaaaagagcagtagcagttccttctttggtgccattgcacagctaaaagggctgttttgaattggaactaagcgaacaaagttctttctggctgtgtctttggcctcctgcaaagcctcaggcatctaagatgtcaggagctggctgccctgctctctatcccagagctggaggaccaggactgggcaaagacattgctcccagtctccttgcagcatcaagaccttccccactcctcaggagcaagcccccagaggcggagcgggaacagagcttttttaaaaaaagagggactcttcttcctctaccccgtcgctcacttgagctcttgctgtttcaggggaagaactcatcagcttcaaggctgagaggcgggattccagggatgttgatgaagagaaggagctgctggattttgtgccgaagctagaccaagtgtgagcagtgctcccgggagggtccccgggggtgccgagatgcaaccctgtggctcagagcagggattccagagggaggaaggacacagcaggccaggcgctgggctcgctgcccgcagagagagacggtttgcaccttaggatgagctagctctgcaccctagccactagggcaggcggaggcctccctcacaccgtgctgcctggacgcctctctgctcctcttccaggctcccctcctctcccacccaggctcccatcctctcccaggctcccctcattcacagccttatatccacaccccctctccctcttatccacactcaacttctcatccaaaagttgaagaagatggccgggtgcggtggctcacacctgtaatcccagtactttgggagactgaggcaggaggatcacctgaggtcaggagttcgtgaccagcctgaccaacatggtgaaaccctgtccctactaaaaatacaaaaaaaatagctgagcgtggcagcacgcatctgtagtcccagctactcgggaggctgaggcaggagaattgcttgaacccgggaggcggaggttgtagtgagccaagatcgcgccactgcactccagcctgggcaacaagagcgaaactccatctcaaaaaaaaaaaattgttgaggaagattcacattagaaactattgccaggctaagctcgaactcttgactgtatacctctgcccctgaggtatgttaggtacaagccaggggagatccgggtctgcctgcctggaccacatttctcatttccccctgtgactgctgtgagttatctcactgtggggcacagtgtacacagggacattttgcaaagcaatctaatatcaacgactttgtagaaacactgagccctaggtgttttctgaaaagatggaagtgtcccatgaacaagcagggagtgaaaccactgggccatttactccatttgaatttgctggacatctgttagaaagaaatacagagctgtaaccctgaccataagcaacttacggactcatttggtgggatcgaaatgcacaccaagtggtcatgtagcaacacagaaagatatattgttagccagagcgaggattctgtcaacaggttctaaaggtagagaaaggggcgacaagtgcaggttggagtcattggggaggacttcatggaggaggaggcggtccttccaccaggttgtgaagcgcagtcaggctccggagtggaaagccggagggagaggcttggaggcaagaggaagaggagctgtgtgcacatgtggatcagccctgtgatgttctggtgttcttggcacgcagggtggaatctccagccatccccaggattccctgtgccatgcctgagacagtggtgatcaggtcagaagagcaggagcaggtgagaagctccttctctgtggtttccccacatggagggcatgaaaaccctgggacagtgattgttgaggggtggcctgtacgtagcgcaataggcactaatagctcacatgccactcactgtccaactggcattccacgcttggacgcctcataatggtgcaacattggtggcgctgggtgggcggtgtctgggagagatggtcagatggggccctttcctgtggtggcgcagtccttggatgcagcccaggacagcagcagtgagaaaccagtgggtccttgaccagcccactgtcttcaactcttggcctagggtaggaactccagccagcagatgtttactggattcctgctgtgcaccccggacaggctcaggcaggagggctggacacctgcctcctgggagccggggcccaaccagaaagagtggactcggacgcatgaacccagttagcacagaaccaggagggagagcgggggagtgctccactgtgtggtgtgagtgctcacagagtgcagagcagggaggccctaaccagccccaaggtggctgggagcatctgtggaggaggtgagacgtggggagtggagaggattagatcaacaagggcgatggacaaggacgttctggaccgggggaaaagcaaacgtgaagatctagagagcagcaaggctaggttcaggtgctgctggctgtgccagggcagcctggcatccctgtagttgcagcgttaccctaaggcaagtccccgttgcacaggtgaggaggcaggaagccccacaagggcaggagtctgttgtgttcacctcgtgggctccaaatgtccacagggcaggtagtccgcccacagctaactggcgaggcggtcacggtgctgggatgcagtgcccaccctagaggaagttggcctgctgagggcagggctccccatgggcagagctggagagaagggggcgggtctgcagcaggtgcagcgggcctggggcctggagccagactgaacagtgaggactggctccacccattccaaggctctgtcccagggtcttgagccaaggagaggcatggaggtgggaggaagctcgtgcttccttttagacctcaggacggccttgtctgacagggcggtggggtcccgtgggagcactttctccacgtggcacctggtttctagcggcaaggttcttccaagcctccacgccctggcacggcatccagctggcccgggaggaggtgggacaggaggaccctttctctctcctcaggcatctaaagagtatgatgaggactccctcatccccagcagcccggccaccgagacctcagacaacatcagcccggtggccagcccggtgcatacagggtgagtggcgggcgcagggctcggggactcctgtctccatctccgagaggggatgcagaagcccaacgtgcatctgccccactcctaggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgaggtgagcttgcgcgggcagcccgtgttctcccctgtccctgtgccacggaggccacgccatttccatctgtcctgatggggaaacagaactgggtgcccctcccctttccctgacttttcctgacacacgaaggtgtccatagccctgagagggcttacaactctcagatctcaggtcgggcacgatagctcacgcctgtaatctcagtgctttgggaggctgaggtgagagcatcgcttgaggccaggagttcgagaccagcctggaaaacatagcaagaccccgtcgttgtaaaaaataaaaagcaaaaccaaaaaaacaactcttaaatattgtgtgacactagagacaaggccactctgaagcctgagggtctgaccttttatgcactgagagttcccagtaagacggcctccctggccgtttcccctgaggacgagggaagtacccggctccagaggcctgtgctccactcccttgaagcagcctgggctcctcctggagctttgctgcccctcaggcaccatgggtgtgatgtggggacaggcctgaccaggaggccctgccttctacctctgtccgccctcctggcccctcagagcggtcaccaccatttgcaaagcagcaagttttctcgttgacgtttctttgtcctcaaagtgtccctctgaaggaaatgtcattatggccagttgatagatgaggtcacccgtctagggatgtcaggtggatttttggaatcaggtgcaaggacaggatctttaggtcgtaggagcagagcccgcatgaaatgagactggtcctgccctcactgtcactgcaggcctggcggggagcaagcggggccatgggaagccctggggaacctccccatgggtctggtccacttagagacctgcctgcaggtggggcctccacgtggctgcggaagtgccttatccatctgggtgggagccggcagccccatccctccctgtgccctgcctgccttgtatgagcacctccccaccaccactgtgtccttgcctcagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaaggtaggggcgggggatcccagggctgggtcccctccttgcggaagaggggtttgagttgcaccttaaaggtggtctttgagggccacctgaagtttgggaagccccaagaggctgagaatggcctggtgtggacaagccctgggtccccaggatgtgtgagaggatgctcagcggctgcctgcagccgcatctgctctgctgggcctctgggcctgggcacttcttctggccacttcttctggccactatgccgcccggcacctggggagggtgtgtgcactgggtcttggggacaaggagactctggggcccctggaagtcctgaacctgtgcctgatgtgaccggggtggtggcctgtgtgtgtgattccagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggtgacagccctcctccccgccaggtcctgggggtggactgaactccaggcctccgggaaggccaccctcttccccaggacatccccacacttttgtctggtgctttgaaatgccacagtggagatctgagtttaaagctcaaaggagagttaagtgggaaggggtgaggtggaagctccctgataagttgcagaacccctggtaacccatcaagctgcacggcccagtctgtgcagcatgcaggaaccgcatgacctccgggagttgactgtggtgctagcaaagatgcaccagccctgggagtaagaagcagaggagaaggggagaaagggctcaggaaggcaagctccaccgtgtcggttctgtggtccaacagcagggcgggaccccgtgcactgacggccactctcaccaggcatggagctgcctcccgtctgattagcccctctcctgcttgggcctgagtgtcctgcctctgtcatttcacaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggtgagaggggcccctgcctcgcttctgttctcggctgctgcagtgcgtctggaacacagtaggggggtgactcgagaaggcgaggccagcaatccccttagtttttgttgacttccccgggagtgaggtgctcttccaagagatggaaggatgatgtatctgcataaaagtccatgcccatgtggtgactcacgcctgtaatcccagcactttgggatgccaaggcgggtggatcgcctgaggtcaagagttcgagacatggagaaaccccgtctctactaaaaatacaaaacttagccaggcatggtggcatgcacctgtaagcccagctactccagaggctgaggcaggagaattgcttgaacctgggaggtggaggttgcagtgagccgagatcattccactacactgcagcctgggcaacaagcatgaaacgccatctcaaaaaaaaaaaaaaaaaaaaaaaaagtccatgcccctggggaagaactctccaagccctaggaggaggggcatgcaggttgctaggaggaagagcagcggggtgagggtagggtgcccagggctgcagacaaagtgagcttcacccagtctcaccttgcacaccacggccttagcattttagtaagctccatgcttacatcctgaagactgtccccagccccatttctgccgctgttacaggaggaacagaccaagcccagtgggaagacataacaggaaccaccaaacttgtatatgccaacgagtgcgccaacttcaccaccaatgtctctgccaggtgagacgaggccagcccagcccagtattgtgtgggccgtcctcaggctctatgctgccgtccaggcctgaggctgaggctccctcactgtcccctccatgtggaagcctccgtgaccacaggtgtggcaatagtagccatggtatggctcacgggctgctcccgtctggatggaaaggatgctctctgttgggcacttgggaacacataactcgccctactttttaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtaacagggctgggccctgcaccgcctctgggacaaaccgtcctgccgttttctccagaacaccattaccaggtgcaggcaggcagtcctccctctgtagacgaggggctccacagctgtctgtctttgagacccctcttgagaagcatcttagagaagcttcaggaaaggagagagatgccaccatgcacatctcagaggaggctgcaggcttttggtccagtgatctatgaaaagagttggcatttgccgaaggtcttgtgcaccagggactattaaaagtgctggccatgccgggcgcagtggctcacgcctttcatctcaacactttgaaaggccaaggcgggcagatcacctgaggtcaggagttcgagaccagcctggccaacatggtgaaaccctgtctctactaaaaatacaaaaattagccgggcatgatggcacgtgcctgtaatcccagctactcgggtggctgagataggagaatcacttgaacccgggaggcagaggttgcagtgagccgagatcgcactgttgccctccagcctgggtgacagagcaagactctgtttaaaaaaaaaaaaaaaagtgctagccagctgagtatggtggtgggggcaggaaacaaaacaaaaaacaaacaaataaaagtgctggccaggctcagaggctcacgcctataatcccaacactttggaaggctgaggcaggaggatcgctttgagcccaggagtttgagaccagtctggacaacgtagtgagacaccatctctattaaataaataactaaaagtgcttttcttgcatattctcatttaattctcatatttatgggtacctttattatcccttatttgtgtattaagaaactgaggctgagaggttaagtaacttgccaatggtcacacagctaagtgagtggtggagatgggatttatccaggtcatctctggccccagagtctacattataacctgctgtgctagggtttcagtagcacccaggtgaggaggcagaggaaagggctcgacagataatgtgaagagtgaaggcatgggggctaggtctgaaccagttaccgatcctaagagacccacttgggttaagatgtgtagtaagccagcagtgatctaatcctcagaatctgcactgagttttcctggggaaggctgagggccccagagaacaagtgcaggactataaccttggttctaatcctgtcttaggcactaacgaggcaaaccggtttttctctttcagcctcaattttttcaactgtcaaatgagttagtgataacttctcagttgaaagctcacccataacaatgagtgagattaaaacagagcaagtgctttccagctcttgtcatgaacaaagcatctttggacagacataaaaacagaaccttggttttatttttagaaacaggatctcagtctgttgcccaggctggagtgcagttgtgacatcatagcccactgcagccttaaactcctggcctccagtgatcctcctgcctcagcatcccaagtagctgggactacaggcacatgccaccacacctggctagtttttttaaaaaaatttgtaaagatgaggatctcctatgttgcccaggctggtctcaaactcctgaacttaagcaatcttcccactttggccttctaaagtggagggattacaggcgtgagccaccatgcccagcccagaaccagggtttgttgttgttgttgttgttttcagaagctatgttatgatattcaagtgaagttttggaatacttgatagcaattcccatcaacatctcagggatatttgaagatccctacatattacaaaatctgttgaagtcgggaagcatgcctcattgatcacaattttggaaataaagcctttcccaaaacaaacagtggatttctcagcacacacccgcatgcctcttgctgaggcagggtgtgtcttggagagggaaggaccgaaggtggaaggagggacatctgggcccttctctccctgacaagctgtatctgcttttcctctcctgcaggtgttggaaggaatgtccctgtttgcagaactctctgggaacctggtgcctgtgaagaaagctgcccagcagcggagcttccacttccagtcatttcgggagaaccgtctggccatgcctgtaaaggtgccggcaccctctggctgagttctcctctgggtctagaaagttggggaggcagaattccctaaaccagacagccgggtggcctagaaaagggcccctgaattctcctttgtgtgattgagtttaggtgagggacagcagtcgagagccgggagggtccctgtcgtttctgcgcaaggcgatgaagtacgaggacacccagcacattctctgccacctgaacatcaccatgcccccctgcgccaaggtgagctggcacctgccgaggagccttggcccgagacggcttccctgtaggaggtccccaaacagaccccaggtccagcacttccaaggggcttcttcctggtggaagcttagagtcccccgaggcatgcaaaggtgctgagctctcctccacatgctcatgttgtggcctggcggggagaccatgccctggccctctctgcaatttgcagtgcagtgctggtcatgggacaggaagaacaaatgttggtatcagatggtgatgggcacattcacgctgtggaccctgggctccctaggtgtgaaagtgacaaggggccctaagggcatctgcctcggtgtccctggcccgaggcctctgaggttcacaccaaggagagctgctaaggtctcccagcccctgcacggcttctctcaggccgctttttcatctacctgcttatcttcccagggtgctaggccctcacagaagggaagcctggtgtcctcagccactgcaaacacccagggttttgagctcagcaaaggagtcttggccacgtatgttcatttgtcgatacctgtaagagtatcccagtcaccacctctgctggggactttggagggatcatacgtctccagaccgtctctgtggttttcgttgctgttgttttgctgctgttgttgttttaatcattagccttccatgctaaactaggaaagaagcaaggttacattcataagtccatggctcaatctctcttttctttttgggcatgagatgagggtgaaccaacttctttttcaaaagaggattttcaggctgggcgcagaggctcatgcctgtaaccccagtgctttgggaggctggggcaagggattgcttgagcccaggagttcaagactagcctgggcaacatagtgagatcctgtctgtacaaaaaaaaaaaaatgaaaaattagctgggcatggtggcatgcacctgtagtcctggcactcgagaggctgaggcagaaggatcacttgaggccgggagtttgaggctgcagtggagccatgatcgtgccatcgcactgcactccagcttcagagacagagtgagaccctggctcttaaaaaaaaagagagagagaatatttttctgcagccttgggcaaatgttcggatgcttttccacagggctgtgatgttaaggccttaaggcagtacagaaacgggtctttcaagcagaaagaaatccaaaaagaaaaacaatcattttaagttcaaccccagctccatcgcatattaactgggtgatcttgggcaaggaactttgtctctctatgcctcagtttacgtattgatgaaatgggagtaatacagcacccacctcttaggttgccgtgaacattaaatagggcctcacaggtgatggggtgacgtgggcttgccgttattacgactgtgattaataacgcatgtgcgcttcttcagcttcccttcactcccactcctcccatgtgttactctttgtgttaagtccctgaagaaacggactgattgtttaccaggactggggtcagccttccacacccctgcagcataggagctcagatcactttctctgggaaggtggggagagtccaaaacccaaagcaccctttcttcttctgcagggaagtggagccgaagataggagaaggaccccgacgcccctggccctgcgatacagcattctcagtgagtccacaccaggtacggcctctgtgtgatgatgcatgcttgctcccttcccaagaagggtgggcgtgagctcatctccccgcagccctgtgagggttctgctgaggtgccgctcgctcagccagttccaaaagcagctgcagagctgactcgggtcttcccctgatcttgcagagagtctagacaatcaccccagtgcacacggaagccacatccatcacaggccgtgtcctcaggcctgtcaactgtgtcctgccctggctactaaatgaaatctaatgcttctccccaggttctctcagtgggacagagcaggcagagatgaagatggctgttatctcagagcacctcggtctcagctgggcaggtgagtggggaattgggggcagaaaagcactttgtccatctcacctaccctcttcccctgtaatgagcaatgaatgaggcatttctaaccctccttttatcacccgtgggttatctgatttgtgattgtctgagctgggtctgctgcccaagccacaccattggctgcccatgaagggggagccccctgcctccatctctgtctgactttcctttctaagaaagactcagcttttgagtttacaggagaccttgaaaaggagggaaggaaagggcaagtctcaacatatttcgctatggtctgtggctgtggctggatctcacagaagtcctgccaaccatcagggtagatcttattttaagggagacaggtgggcaaataaagtgaaggctcagaatgtgctgtgcccaaccacagaccctagaactggattctccctgtgtaaccacagcaggtccattgcccaatgtgagtggcaagtcaagacacacggagacacggggttgcagcggtgaaagaggcttaatcccaggaccaccaaacaaggagggaggaggaaacctcaaatccgtctccccaaggaggagttcagggctcgggctgttaagggctttggagtggctggagtgtgtaggtggttgattggttggagagtgcagggtggagtcatggacagggagagcaagaagctacgttctcgtgctgatccctgccttcaaagtggttgctggaattgggaatctgaaaaccatcttaagggatccttaaacagaagcctaatgtcagaaaccctgtctttaggaacaatgggggtgcgagtggtcagtatccagcactgtgtggctttgagcaacaaagaagaggacccaagcgcagcttggtgaatgcttaattataaccgtatttctgtccagagcccggtgctcaattcttgttgacactgagatggcttccccttcccctccttattttttgttagcttttatatgagtggactcccttcattcacttcccctggagaacactttagacacactcagaaaccttttggcaatgacttgtggaaaggccgtgtgacaaactcagaagttcagtcacggctccttcttttaatcatgactgctggctgctcagggggcgtgtgtgtgcatgtgtgtatgcacgtgtatgtgttgtgagtgtgtgcacgtttgtgttgtatgtgcgtgttctgattctcaccatcactttctccccagtcttcttcatccttgaaattagactctaatgctattttccttctaaagcaataacaataaaaataatgggggattttggctaacagtctgcattattgccttgcatttagatgggaacttgtattttcattttaaatgtaaataaagcctctccctgaagacgcataagctcaggagtccatttctgttctcattggttcttggcagtagggcatggcgtggcccaggcagtgctggggtgagaatcggcaggtacggctgcctcctggctcagggacttgctggctctgtgaccttgcagaagttgctgaccttgctgagagttcatgtcatctcatattggaagttacgaaaggaagaaaggacatttgatcattcattcattcaggacctatttaacaaacacccctcccattcttccattttctggggacataaaggtataggtgctggcatttcataaggaatttcttgataagaaggaagaccaaacccacagggaggctgcctcagagctccctgtgctccccactgggtccccccacgccccagtgcccacccagcctgtgtgctggaggccccctgctgttggtgagctggaggctcacatctgctgttggttctttgcttgcagagttggcccgggagctgcagttcagtgtggaagacatcaacaggatccgagtggaaaatcccaactccctgttggagcagagtgtggccttgctgaacctctgggtcatccgtgaaggccaaaacgcaaacagtcagtaccgtcccactgaggaagcctgtcctaggacctcctccccaccaaactagttcttccttcaaattccattcatgacactggcctctggagtcagtctgtctctgtctctctcacacacactcacgcaccactcgcatcaggaggtcttccaggcagtcctgccagaaggcatgaccagagaagcttggcctcagcctttctcacatccttggaataagataaaaattgcaaggcctggcacagtggctcatgcctgtagtccccacactttgggaggccaaggtgggagggtggcttgagcctaggagttcgagaacagactgtgtaacatagtcctttcaaaattagccaggtgtggtggcacacacctgtagtcccaactactctggaggctgaggcaggaggatcacttgagcctgggaggtcaaggctgagtgagctacagttgcactgctgcactccagcctgggcaacaagcaaaatcctgactctaaaaaaaataacataaaaattgcatcaggactcctagatgacaacatctgtgcagggtgtatgactcatctttgaggtcttcctgttgaatttcccaagcaaatgagtattgtcctctcaggacacagtctgggtgagctggaccccagtctgaaccagttctcattctcccaggagcttcctccaacctggagggagctttgcctcattctcttttcagctcctcctcaaccagtttcccagactcaaaaacactaagtggaaattgagtgtttacatttgcatctcaaatcatctggcaaggaccaagaatttcaaaaggacagaatctaatcattctcatccttattttcttgtagtgctcctcttagcttacaaaataataataaaaaaacagtctttctagacttttaaattggccactgtggtgggcacggtggctcatgcctataatcccagcactttgggaggccaaggcaggtagatcacttgaagtcaggagttcgagaccagcctggccaacatggcaaaaccttgtctctactaaaagtacaaaaattagcagggcgtggtggcatgcacctgtaatcccagctactcgggaggctgaggaacgagaattgcttgagcctgggaggtggacagtgagccgagattgccccattgcactccagcctgggtgacagagtgagaccaataaataaaataatttattttttttttggtaacagagaccaataaataaaataactgcgcactgttagcatttggaaaagatctgctgaagtgtaaaaagtattctccccagaggaagtttgttttgactctaataaaagagggtgcctccaccttctgaaaaaaattatctcctttctccatcttcatcctggccccattttctgagcccatgtgatcctcgctcaccggcctggagtaacgtgcatctctcttctgcgcccacagtggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggtgagtgtcacctggaccagatggggactgagccggagccctgccctacaggcatcagcaccaataaccccttcccacaatacgtcatccctcaaagcccgctctgcctcccattggtgggaggtctggtttgtcagcaacaagttcctcctttccggggaagcagaggcgaaggagagagagatggctgctcctgtgcaggtgggcatcgcctccgccttagcctttgcagccctgcagaatggcccccaggcccttgccatcagcaactgcgtccccacagggcgtggtgtatgagaaaaagctgagtcagaggcctccagctagagactgcccctacacagctgcagactttccggtagctctttgcaaggcgtgggccctctttggggtgtcagtgtccccatctgtaaaacagtcagtggttgggaagcagagggcatggagattcctggcccaaggtctagtgcagtttaactggacggtgttttacaaatcctgctgtggccacttctagggactgagcagtttgctcttcctggagccgggtctctctgctttttcctctcccccttttctatcatctcatctccttcccctcattctttgttgatgtgactcagcatggcagggatcccccgtgagatccagcccaaggagaggatgtacaggaggctgtgacctctgcccccaagcccctgccactcctgggccaggccccctcgcaacaccttcctcgcccgccccctctctggccagcgggcacataaacagcgaggccccactctccggccaggaggtctgggttctaggcccttccttcctgccaactccctgcatgactgagccctctccccttctgtaaaatcagcaagttggattggatccctaaaattccttacagaccttgaaacaaaatttccatgtctgtgacgtggcttcctcaggtggctgacgcgtcaccctggatgcctgcatggtgatgtgtatgctcctcaagctccttgtcttaggggccatccccgccacgcccaggctgagggtgggcacctgtgactgggtacacagtttgggggcgcggctgagggcgagtcccaggtgggcctgggcacggagcccctaccaggggaccctgctcgctgagccctccctgtcccctgctctgcatcctgtgtctcctgaagtgtgccatcttgcatcctgggagcagggcccatctgctgatcacgtcccattgcctctcttctgcctctgacctcatcttgacctctgtgcactcacgctatcgtgctgcctgtctccactgtctccactgtccccatttcggcaggcgcagagccggccacgtccacatgcatgtcatggcccccagccctgtctccccacgcatctcatggccatgtcctgggtgtacttgtgtgtgtgcgtatgtgtgtgcatgtgtgcgtgcatgtgtgtgtgtgtgcacgtgttcatgtgtgtgcgtgtgcatacatgtgtgtgtgtgtccgtgggtgttgctgtgtggtgctgcctgctgcgtgtgcccggcccactccccaggtccacccccttggggattccagcctcccctcaggggacctggccagagctttacaggagctcagtgggctgagggcggttgagggaagccacaaacctggggaaattctagtgacaaagctcctctcccttcccatgtgtcgagacttctttgacacccagcgcatacttttggtcaagtcagaggggcacgcttttgatttcctgtgccctgattaagcacctacaggacaatgggccaccagagccacatgagtgtgaatattcacagttacagacctgggcatctgtgagcatctccccgggccacagacccctagctcccaccaggccttgaggcattcttgcccgagtggttctcaattcctgtgtgggactgggcctgtgcactccatgtctgctgaaagggctctgcttcagggggtcagcccatttggcaaatatttttcaagtatcaaccacatgccaggcactgtgctaggcaggagagagatacctgttctcaaccagacaaaacaaaacaaaactctgcctttgtggagcttttccctcctgtgaggagagccacgcggggaattgtatcacacaccagcagttaacgtgcatggtgcaggagaaacagaccggagtcggggccagggggactcatggtgcaagggaagcgggtggcactcgaggacttgccagagatgaggtgggagccatgcgtcggcactgaggtggaagatttcagagcagggagtgtgaagggggctttcctgatgcgttcacaggacggggctggaggcgggggcaaagggacagtgggagagagggcaggtgtgggggctggaggggtgacacggagcccacccatagactgtcatgaggacattgggtttgacttggagtaagctggaaagccatcagagggttctggccaaagagtggcatgattgcccttaagtctttgagggagccctctcccgagtagttgatttcagatggtcacagtcgaatgttctgtgcttcctggctgctctgtgcagcctcagcagtccctgacaccctctctggcaggtccccggtagacccagctctgtgccccagcagactcatgcaccgatgccctgctttgtccagaatcagcttctttatatttttcctgccttcttccttgccccagaaagtctggccctcatctgggtgcccttgtgttctggagagaaggtggcaggacagtcagaggtctaaggggggtgggggggcactacaggctctgcagcttctctgctcttccctgggcagggctcgtgatggcctgacctggtgcccaaccagcccaatgcactgatgcccacagtcggaccttggctcctctgtgcttttcctggtccctctgcatgtctgagcctccttctgaggccctgggactctgggtagtgataggcagctctgtgagcacgacataagtgggtggtgtccaggaattagaagcctgaggctgtctctcccttcatagctctgctcaccaccagtgccttaattggccagagcagaggggctcaggccaaaaggccagcgtgcttctcccacataggagaggacggcccaggccctgggaataaacatgaagaaagcatggcctatagatccaaaataaaatagcatgtttctgaaaataaaacagacttcccttatgagaggagaaatgatcatctcacacccgtgtgagttccatttgacctgataaatcagacacaaactaatgtctacttggaaataaaacttgttttatttccctcaattcttcacaactgtggctagtgaagtgtggccttgtctagggtgaggctgtctgatgacccctgttgcccatttgctgctgacgttaagctagcaggacgattattacctctgggtcagcacagaaccagggcagtgacctggaatgagcagggaccacttgactgtatgctgccccaaaccaatatgtgtggctgccttttacctgacttctccaacatgtagccccaagaggaggcctctagactgagggaggggctggtgacccaggtgtggtggggctgcatgagactaccagagagacagacattctggaactcaccctgggggatccagtggatctgcctatggtctggtccaccccagacctgtgagatgttcctcatgaggatgcacttgtgcttctgcaagtattgctgcagcttcacagtgactcccaccagcaccagcaatacagctagctacctgtggccttggatctcagccagcatggctgggagagggagcagctgggcatgtaccctaaatgctgttaccagggaaggactcccagagtgaagacaagtagggacttcctgcagaggtggtacatgtgctctctgtatccatactttttttttttttttttgagatagagtttcacccttgttgccctggctggagtgcaatggtgcgatctcagctcactgcaacctctctgcctcccgggttcaagtgattctcctgcctcagcctctcgagtagctgggactacaggtgcccgccaccatacccagataatttttatattttagtagagacggggatctcaccatgttggccaggctggtctcaaactcctgacctcaggtgatccacctgcctcagcctccctaagtgctgggattataggcatgagccactgtgcccggccccttacatctttatttgggtgaaattccactaaagcaaatgccgtggaagtctcaaggtgggaaactcacaaaaggaatccatgaatgagcctcaagtgttctgtggcgcaaagctgccctctcccagttctcaagtctcatcgcaattccaaggagtgatggaatgttcatccagccaaatccaaggagctgtgtcaggtgcgatgtgtgccacttctggccaagacaggataacagggactgaatataccctcctgcttgaaactactgcagaccaaaaaatggacacactatatgagacaacagttttcaagacattggatatcaaataacaaaggacactgatccacaaagcatgggaaataaatgaagtgagccctacagctgtctagtttaccattttgaaagtccaggaaggccgggcgcggtggctcacgcttgtaatcccagcactttgggagaccgaggtgggcggatcacgaggtcaggagatcgagaccatcctggctaaacacggtgaaaccccgtctctactaaaaatacaaaaaaaattagccgggcgtgatggtgggcgcctgtagtcccagctactcgggaggctgaggcaggagaatggcgtgaacccgggaggcggagcttgcagtgagccgagattgcgccactgcactcccgcctgggccacagagtgagactccgtctcaaaaaaaaaaaaaaaaaaaaaagaaagtccaggaagaccaagacagctggagttctcaagacagagcaccagagaggagacagttgcacagatagaacactctggagtcccccacaagtttcagatgagtattagccagctattcccaattgatctctcacggcctttgttcaggggacaaagaaggatctcatctcacaaatagggaaaaattaacccccaaagctccagtcctccctgataaaatttgaaagcaaaatgcaaaaggatcaaactgcttccaagtaacttaactgcgtaacagaacaaagctcaagcatacacggatacaaaaacatccagcactccacaaggtaaaattcgcaatgtccagcatccaattaaaagtaatcagacacacaaagaggcaggaaaacaggatccataatgcggagaaaaatcgatccattgaaactgacccagagttgacaaagatgttagaattagcagacaaaggactgggcatggtggctcatgcctgtaatcccagcattttgggaggccgaggtgggcggatcacctgaggtcaggagtttgagaccagcctggccaacatggtgaaaccctgtctctactaaaaatacaaaaaaattagctgggtgaggtggcaggcgcctataatcccagctactcaggaggctgaggcaggacaatcacttgaactcaggaggcggaggtggcagtgagccgagatagtgtcattgcattccagcctaggcaacaaaagcgagactctgtctcaaaacaaacaaacaaacaaaaaaagaattagcaaagatactaaaacggtgattgtaactgtatttcaggtattcaaaaaagctaagtagagacatggaagatattttttaaaggcccaagccaatcttctagagatgaatgtgtaggatcaatacactggatgggattagacattagacactgcagaagaaaagattagtgaacttgacaatacagcaagagaaactccaaacatttttcttttctttctgttttggagaaacacaaagtgagctatggggcaatttcaagtgacctaatatgtgaaattacagttcccaacagaaaagaaggaagaaaaagtattgtaagaaatttggggctgggcacagtggcttatgtctgtaaccccagcacttttggaggcccaggtgggcggatcacttgaggtcagaagttcgagaccagcctggccaacatagtgaaaccctgtctccactaaaaaaattacaaaagttagccaggcatgctggtgcatgactgtagtcccagctacttgagaggctgaggcaggagaatcgcttgaacccaggaggtggaggttgcagtggaccgagattacattactgcattccagtctgggtgacagagttctcaacgcaaaaaaaaagaaaaagaaaaaaaaagaaatatggacagaaacttgccaaatttgataaaaatcatgaagacatagatccaacaagtttgatgaactgcatgcacaggaaacacgtgagcaactctatcagggcacattattagcagactggtcaaaaccagtggtgaagagaaaaatcttaaaagcaatcagagggaaaaaaatgtgttatgtacaagggaaccaaaataagattcacctcagatttcttattagaaacaacacaagccaaggccgggtgcagtggttcacgcttgtaatcctggcactttgggaggtcgaggtgggtggatcacttgagatcaggagttcgagaccagcctgggcaacagggtgaaactccatctctacaaaaaatacaaaaattagccgtgtatggtggtgcgtgcctgtacttttagctactcagaaggctgaggcaggagaatcgcttgagcccaggaggcagaggttgcagtgaaccaagattgcaccattgcactccagcctgggcaacgggagtgaaatcctgtctcaaaaaaaaaaaacaaagaaaaaaggaaaaaaagaaacaacagaagccagaacatggtgtggcatctttaaagtatgccacatctttaaagaagaaagaaataacatctccaaagtaacctagacttctatacctagcacacgtaacttcaaaaatgaaagcaaaataaagacttttctaccttaagaaattagaaaaagaagagtaaattaaacccaaaatcatagaataaaggaaataataaagatcagagtggaaatcagtgacacagaaagcagaaaaacttggagaaacttaatgaaaccaaaagctggtgatttgaaaagatcaataacattgataaacctctagccagactgattatgaaaaaagagaagacctgcagattaccaatatcaggaataaggaatatatactacctatagaatatctacagattctataggtagtaaaaggacaataaagggatattatgacaattttgtgccagtaaattggaaaacaggtgaaatcaacaaattccttgaaagacacaaactatcaaagctcacttaggaagaaatagatatagccccatataaatgaaagacattaaatgtatggtttggaacattcctacaaagaaaagtccatgcccagacggcttcactggtgaattctaccaaacatttaaggaagaaacaacttgtttagaaaattgaaaatgagaaaatacttctcaattaagtttatgaggccagcattaccctgatattgggaagaaagacaattaacaagaaaactgcaaaccaatatcatttatgaacatttatgcaaaaaatctaaactgaaatgaacttggattattaccttgtatacaaaaatcaactctaaatgggtcatagattaaatgtaatatctacaactataaaacttctagaagaaaacataagaaaaaaaccttaaagatcttggttaaggcaaagatttctcagatacaacaccaaaagcacaatccataaaagaacaaattgacaagttgggcttcatcaaaatcaaaacttctgctcttcaaaatacactgttaagaaaatgaaaagacgagctacagactgggagaaaatattggcaaataatcatctgctatagtattggaatatacaaagaactctcaaaacttaataataagaaaacaactcagtttttagattgagcaatagattcgaacagacttttcacccagaatatatacacatggcaaataagcacatgaaaatatgctcaacatcattagtgattagggaaatacaaattaaaactataaggaggtaccaccacatacctaaaagaatggttaaaattaaaaaggctggccatatcaagtgttggtgaggatatgggggaactggaactctcatacaccactggtgggaatgcaaaatggtacaaccacttgatcatttctgacaaagttaaacatatacctactgtacaatcaagtcattccattcctagctatttacccaagagaaaagaaagcattatgtccatacagactagcatctttacttgtaatagccacaaactggaagcagcccaaatgtccattggcaggtaaataaatttacaaaccgtgatatatccttccaaagggctatggcttagcaacagaaataaattattgatacatgcatcagcatggatgaaacccaaattgactacgttgagtgaaagaagccaggctttaaaaaaagagagagtgcatactgtatgaatccgtttatgtaaaatcctgggaaatgcaaactgatgtgtagtggcaaaaagcagatcggggtcacctgggaatggtttggggttggcagagggggaaagggcagggagagattacaaagaagcttgaggagacctttctggggtgacaaatgtcctttttcttctttgaggtgatggcttcatgggggtacacatgtgtcacaacgtatcaatttacccccttttaaagatacacatttattgaatgtcaaacatacctcaacaaagctatttttaatagagattaatggcaaagtctatggaaaagaccaaacttactagctgtatggccttccgcaagttgctaaacctgtagtttcctaatctataaagtaggaattatattattttcctcatgtggttgttgtggcaattaaaaacatgttagatatgttttgcactaaaaatacgctcagtggccgggctcagtgactcaaccctgtaatcccagcactttgggaggctgaggcaagcgaatcacttgaggtcagcagttcgagaccagcctggccaacagggtgaaaccccatctctactaaaaatacaaaaattggccaggcgtcatggcgcatacctgtaatcccagctactcccagtggagaggctaaggcaggagaatcacttgaacctagaaggcagaggttacagtgaactgagattgcattactgcactccagcctgggcgacagagcaagactctgctttaaaaaacaacaaaatgctcagtaactgatgtaaataatataaaatgctcgcaagagtaataagaaaaataatcatcagttgaccccaaaatgtcctgcttttgtatatgtggagggttttctatgaagggtttgaaggccatggccctggtcagctatataattcctcaagtcacagtttcatgtacagtgacttggagttcagttcatggtaagatgtgacccacccatttcacctactcttcccactccttcctccttgttcttcctagtttggccagagctaaaaggggtttccctcagtctctgccgctgtgcagcccttctcccaaccaccccaccttcacgggctcatcctccccgctcatttgggacctggaaccaagtaggcttgcagggaagaaaacttccctgggagattaagagaatgcatgcggagtacacagcatggctccgggcacgttgaacacacaggtacatgttagcaattgcagttccactgaatgtgcctgaggtctttctgttccagctgctgggtcctctcacacacctggagagctcttcagtggtcatggggctagtggaggcccaatcctgttgtaggaaagggtggggcgaggaaggcaggcatcagccctgtcctcatgggtttgcatttctgagaaccgccttagcgagggaccctaggacagcctcagagatgggagggagcaacaggagctgaagctgggaaaatgccatgagacaagaagctgtcccatctgtgagtgtgtgggtgagagagagtgtgtgagtgtgtgtgtgtgcatgtgtgtttggggtttgtcatccccattcccatagcacagtgcctggcatgtaatcggacctctcttattttggttgaacagtgagtggatgagaataaatggagctagtgatgtaaaagcaggggagcaggtgatcaggagctgaggccccgagcggaggctgaggccccgagcggaggctgagggggcaagaaaggagcccgcctggcttgaatcaaagcacagcccgggggcagttgcatgtgagtaggagtgggggtaggggctgaatggcagaatggagcatttgaactaggtttgaactctaggctgggggtgtctggacatctctcgatggcaggaaggtccctagagactgcaaggggcagccctgcccattcccagggtcccccttcagctctgtgggctttccagctgctgtaagcacgtacttgcttcctgatttcctagacaggccaagcccattggagaatcttgtcttctagtctcttctcccacccacagaggcacctgctctgaaggggcatcagagtcctctttttcctgtcaatgcacgggtcatgcactcagggcctgagcgagctggctcccatcccaccaggtcggtgctgacctgcagctgggacaagcagctcagggctcttggacacagggttttggggcgggcagacctggtgcctcttggtgccttctgaccttgccccttttgagccctaagagccctcccctgtagcactttagatcgtgcagagtttctggaaccaataggcaacttgaggaaagtgatgcctggccacaccagaaggttgtttcccatttgaccaccacagtgaggtctatgggtgtttagtgtaccctgataggcccctcaagggcagcctggttactacccctggttctgggtggcctttccttccctttaaggtacatccctgagaacctaagagctaagctaaagtgaagttttgagtagaggagcaacgtctacttctgcccagccatggagaagtggagctttcatgggatcagagacagattggagcacaagtcctttggataaaggcttctttatctagtgctctgaactggataagaaagtccaatctcctcttcgccatccagcagggcgctcccccatctctgcctcacaccctggctgcccccacccaattcagagccttgcttctcttgcctggatgcccaggcagcagccacaaggcctgagcattgggcctggagcttggaaagcccccaacccaccccgaatgtgcatgcatctctgtggccgcacccgcatgtgtgtgttcgtgcgtgtgcgtggacctgcacgtgaatgcgtgggacaggaatcactgctggagcatgttgccctctgtctgcccatccaggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacaggtaagagcttgactgcgggagcagggtccctttttgtcttctgggctcctgggtaagattatgcctggcagtgaggacagaggtgtcgatgccaaccctgaccctgggttctaattgcacaggagcacatacattcagtctggcagatgccatatataagagcataggtgccatctgcaaaagccagtgcctccccaagaccccaccaggtatgcccggcaggagagaccccgaggagcactgggagagcacacatagggacatatgggcgccgggagggctcacttagggacattagggcaccgggagagctcacttagagacatgagggcactgggagggctcacttagggacattagggtgcctggagtgctcacttagggacatgagggcactgggagggctcacttagggacattagggcactgggagggctcacttaggacatcggggcaccgggaggactcagggacatcggggcgctgggagggctcacttaggacatcggggcaccgggaggactcacttagggacattagggtgcctggagtgctcacttagggacattagggcactgggagggctcacttagggacattagggcactgggagggcttacttaggacatcggggcgccgggaagactcacttagggacatcggggcgccgggagggctcacttagggacatcggggtgctgggagggctcacttagggacatcggggtgccgggaggtctcacttagggacatcggggtgccgggagagctcacttagggacattagggtacctggagtgctcacttagagccattagtgcacgggaagggctcacttagggacattagagcaccaggatggctcacttaaaagagcaatcatgaggctggggaagaccgtgggtcagctgctgctggagctggcgttcggagctcctctccccttgcgtgcttccggttgaaggccatatttagttgaagaccatatttagaagcaccagtacccagggaagttatttgtgtgcagtcacacagcctgcatgtgacggagctgataatggcgccctccccacttaccccctttgaaggaggggctggtgggcttaactggggcaggacggagctttcagctgtagagcagtgggtgctctcttccccacgcttcccgcactgagaagcccccgccctgtgccgcagcagaaaagcagcgtcggcaggtcaggagaaggtgatgcatttcccagacactgcaagtctgcggccgaggaccggctcaccttggagctctcatcgtcccatctgggccagggcctacaccatgcccctccgctgagtgcagggaaggatgccaagacaagccaggcccttgccattgtagaaagagatgagacagacatgagatggggctcacgttgtcctcctgggctagcacaggaagcggatgacagaggaatcccctttcctccaggtcaccttggcttgctgagttttccctaaagtaaggacatggttcttgtgcccccaggcagctgttccaggcccccaccccaaggagctcaggactggtcaggtaaaggaaagctgttctcatgtcctttccccacctgtgtgacccctcagtcccacctgtgtgacccctcagtcccaccctgaggcccaggctagtggggccattccacaggatccatgcagcctggccccaataccctaacaggaagggaaaggaagtcgtttggaagttgagacagcaaagatttaattttttttcctacacaaatctttggattcatggggaggattgaacagatggagcttaggctggtttaaagtgaaatagtggccttcccgggagagagacaccttcctgggacggccattccttcaacaagcatttattgagcacctgcaggggctgcatgctggcccctgcattaccgcagcagtgttgctaactgggttcatgaacgcctgggctctaggcctattttgtcacttcctggtgctgtgaccttggtcagccttctcatggggacagatgaatttcatccacttactcaacaatatttattgagtgcctactgtgtgccaggcaccaataaagagtgcctgggtgccagcattgaatgaaacagaaaaaagtctctacctgcaagaagcgtggttctagcagggaaactaactagaaacaagataaagtaaataaaattagaagtcattaaaacagaaattctagataatacgtgctaaaaagaaaaatcaagcagagaaggaggacaggaggtaggcgtgtgtgtggaaagaaggctgactggaattacagatgggtggccaggggaggcctgcatgagtgccagctgagagacttcaaggaattgagggtgagggtgaggacatctcagggaggatgccccacagaaggcctagccctttgaaggagaccgtgcctggcacgtgccctaacagagtaaccaagcccatgaagctagggagggaatggtgagcagggtaagctgcacctgccttgagaggaggctggcgcaacctggcagagaagcaggaggtgtgtcgggaggaaagggccgtgggcttgtgggctgggacggcagcggtggccgtgctgagaggtgggcgggtgcagggcatatttcagaagcatctgctaacaaatacaatgtggggtaagagaggaagagaggggtcaaggagggcagtggtgtcctcgacctgcccactgcaaggatgaagataccagggatggcagcagggatggggtgggacaggctaggggagaagattttgagtgtggattggatcgcactgtcctggagatgccaagtagagatccaaagtagacctgtgagccagaacccatctctacaaaattttttaaatagctggacgtggtggcgtgtgcctgcagtcccagctactcaagtggctgaggcaggaggatcgcctgagcccaggagtgcagagctgcagtgagctgtgattgtaccactgcactgcagcccgggagacagaatgaagccctgtctcagaaaacaacaacaaagtaaagatgtggaggaggcagcggggtgcacacagctgtaggtctaggaggagagccaagctggagacacacatccaggcacgctgagtgtagagatgggctttggaaccatgggatgaatgagcttgcttaggaagtggatgtggacagcggtgaggtctgagaactgcaccccggggtgctcctatgttcagaagtcaggaaagctaggaggaacaagcagaggacatggaacaacagcggccagagaggaagggggagacgccaggctagcaccttccaggagccatgggagaatgtgtcttgagggggagagaatgaccaccttgtcagatgaggactgctgagtgggaagggcctggagagcagaaggaggtggtggcagagtttgaggatgtgggatgagagtgtggaggccccagtgtttggaccattagggtgagccaagtgctctgggagccccaagggcaagctgttcacccacagggagggaccagtggcctttccacctggacagcattagatgggccacgtgtacccctctgaaccacagcagtgaggtgagcaatgtgctcatgcgcccctgacctttggagggatgggaggacggtctgtgtccttgatgagccagagctctgggtggggagagtgtctaaaaggaatgagactgatgggtgaccaggtgtcttttctctctccccggccggccatctgctgcttcttctggaccccagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggtgagagcccgaggggagctgcgtgctgctgttccttcccagcatcggaaggggccgggactccagggctgcctctcaggcactcaagccctgagctaagcatatccccttcctttaacacttgtggtggtgcttccgtttctctagaagtcaagggcaaggcctgcctttctgcctcctggatccctgctaaggcgcctgtacctgttgggcagctgctgatcagagtggctgagcaacttgctcaagatcacagtttcagaagtgggctctaagctgggtctggctgactccaaagttgtggcttttgttggttttcttgttctgtcgcgttttagaaagggctaggaaccgagcactgggcgttgggcttactctcctcctatggtgacctgggtgacgtgcccaaggcgctctcttcccagcacctcagggtcctcactggtaaaggagggagtgattggaatgtcgccaaagttacttggctctggaattctgtggctattcacgtggactctggatggcggtcaccaagtagaagaggggccctgggatagagagaagtctcctctcctgctcctgatttcccaggcctctccctctcctggccctccctcctttcttccacttccccggattcccttcgagtttgttgaactttattttgttcgattcaatcccccttccccattcccaggccccatgatgatctactcgtggccaatcttgtttcatctgcaccccccactttctcccactgactattatttggaagcatatcctggccatcgtattaatgggtgtcttttccatttgtgttcttataaaacatgcaccactgttctccacatgcgtgtgtttagtatgtacatgaacgacatgttctgtctctgttttcacgcctcatccaggcatggtgcttcctcctctcctctccttcctctctttctttccttgtctcccttctttcctacctgaaccttagactccaggactagggtggctctggaaggaaggccctgagctgccagccatagaactgctaggaattcagtcaggttttatttagaatgctcccctgccaagtatgtgccccgggcagggccagcgcctgtgtgcactcctcaccacaggcggcccgtccgtttcttccatcaggccctcctgggcgcctagttctcctgctcccagagcacacatgatcttaactgggtctcttctcctgaatccctggggaaagagaaagacgcctacagcacttttttccactgcccctctgtggtcagcctttggtgaggggaactggaagggccttctagatcacacatccaactccctcaattataaatgagggcactgtggaccagaggagccaagggctttctccagggtcacacagtggaccaatgtcagggaccaggagggtccagatccctcagttcccaagccctacatcctcacgtccagcatgcacgtgcaaggccagcatgcccagcccggaactggagacgccgatcagagggcctggcaggctgctgccggtgcccatctcacaggccccgagggctgataaggatgcccttgaaggtgattgatggtttgcaaagcacccacttattagtatttccactggacctctgaaaacagtgatggagatagagagattgcatgtaacttgggacttgggaggtggcctgaaatgactgtgacccagctgatttctctgaggacttaggaggaaatatctgaagttggactcttcttgactgggccaaaaccagatgcttccccggcttctttgcacatacttttccccgtgctttcttgttgaaataagcagcattgtggagtgagaggcatttggaatgtgactcctccgtttacttactcctccacctaggcagaatactttgcttctgtttcctttgtgtaaaatgggaagacgatagaacctccttggttaggactgtggtgaggtgtcagtgaattaatgcgaaatccacatagaaccatgcactatcacaagcgtttgccattatcattcatagtgttagcattcataagcggcatgattgtcccagcagccttgagaaagggtggggagagcactttaatccgtgcttcacagatgaggaaactgaggcacagagaaggtccccagccttcccaagaccccacagtaggtgagttgcagggttagtctgctgtgtcccagatctgtgttctttctgccatgctgcattgccactcagagaggaacaacctgatctagaaagtgaaattttttccagccgcagctgctgcggctacatttgtgaatcagctctgtaaatacaagtttaatacgcgttgttcctgctcagtgggcgttgatagcccagccctggaagagcctttaagaacaggccttaaatagacacaccagctccatgcttcagttttgggaggctgtaccccataaaggaagggtgcaagggcctgtgggctgacaggaattacagaccggcttccaggtggccccaccacctgtgctgggcccctgctgggctcacttgactgtccctgagcccatcactcacccttttggagcaatttttgaaacagaccgctaagtacccagggtattagctggtctcatccctaccatgccggggaacagcatttggatcaccgcagtagcagcccaaggagacacacaagtagctgctttctcggactgtattattttctgaaagtaagaaactttccctgggcagaactctttctagttcccatggggatgggcaggataggcgagaggccgagcccccacttccaggtctctgggcagggcggggttaggcagcagcgggtgtcactcacacagtgactttcacttgtgctttcagtgctcaggacatgggcacctgccggcttccttctagcccggttggacagctccggcagctggtttggggaggtaaaattataggagcgtgatgtcacccgggccactcagggcagagcctggctgctgggcagaagggcacttgggccgggctgcttcagccgagagggccattcggtgtcctgcccacagagagagaaacagtgagagaccaagagagcaaaccagagagatagggagggggaatgcaaggggtccctgggggactcaggagtcccagtggagaatgagaggcaggccccccgtggtggccggggccctggctgccagaggaccgggctggtgaggaggcgaggatgtggactttcgtcacccagctgttggtcacgctggtgctgctgagcttcttcctggtcagctgtcagaacgtgatgcacattgtcagggggtccctgtgctttgtgctaaagcacatccaccaggagctggacaaggagctgggggagagcgagggcctcagtgacgacgaggagaccatctccaccagggtggtccggcggcgggtcttcctgaaggtaaccgcctggcaggaggccggcagggctggtggtgtgggcgccggaggccggggctgaggggacgctgctgtggggagctccggacccagagttgggagacgccggaggaaaaggaccaggaggcccccagggatcatgttccaccctgggagccagagtgtgtgtgcgcccaccagaacctgccctctggtgcccagtgcattgtgacagtgacattaaacactcagctttgggtctcgggaggctgcgctcatcctgtttctttctttgtttctttcttctttctctctcttctcttctcttttttcttttgtttttagagatgaagtcttgctgtttagtccaggctggagtgcagtggcatgctcatggctcactgtaacctgggcttactgtaaattcctgggctcaagtgatcctcctgcctcagccttctgagtagctggtactacaggcacacaccaccatgcctggctattttaaaaaaatttttgtagagatgggggctcgctatgttgcccaaattggtcttgaactcctgggctcaagtggtcctccggccttggcctcccaaagtgctgggatagcaggcgtgagccaccatgggattgcacccggatcgtcctgtttctgtcaccaactggctctggggtttcaagcaagtcacattctgggtgatgctgcctgtcgaagggcttttctatactgcaaagtgctgtaaaaataggaaacaggtgcctcacttcctctctcagggcctcctccgtcagacttgcataattgcccccattttgcaggttcccagggggtgttgtgagggccaagtgcacaattgtgagctcgaccgttcgtcttcaggcctcccagaccctcaggggcgccgcccacgccctgggagccctggcatggctcctgctacatgctgagccgggtttcctgctgggggagttattgggccatggctattgtggctactgctgtttcatttcctcgtcctccacccttcctcccagactcccactcaccaatcttgcattttctccctttctctaattccaggggaatgagtttcagaatattccaggggagcaggtgacagaggagcaattcacggatgagcagggcaacattgtcaccaagaaggtgggtgcagagtgttcccctctgtgctggggagaggcaggtgggctagaagctaaaaggtggtagaagccagtggcttctccctgctgccctcacagcaggtgagcacagccaggctggctgcccccgtgctcaggagggatggagggcccaggagctgggagctttggtcatctgcagtccagtcatggtgtcctcacaaccgctttgtctgagtcaacctgaatagcttctgctgctcttttccagaagggccagcccccaggaaacatcccagacctagtcccatgatgcctaaccctgaaaacagctgttaaacaagcagtttgagcatccctggcctaccatgggcctcctcaaataaaaagaatgtgggccgggtgtgctggctcacacctgtgatcccagcactttgggaggccaaggcaggaggatcgcttgagcccagacatttagaccagcctgggcaatatggcaagactccatctctaaaaaaaattttaaaaaataaataaatacacacacacacacacacacacacacagagagagagagagagagagagacacacacacacacaaaattagccaggcatggtggcgcatgcctgtagtcacagctactcaggaagctgaggcagaaggatcacttaaacccagcagttcaagtctgcataagctatgattgagccactgcactccagcctgggtgacagagtgagaccccatcacaataattaaataattaaaaggaagtgaaaatgcattggattggtagcagatattaactcagagacatgaccttgcctgtcaagtgtggggcacggtgctagctatgggtaaaatagaggaggagctgaggcaggatctcgaatgtgcttctgcttaggcgcagctctcatcacccttgagcaaggctccttgtgcgtctgtcttgcctcctgcactgtgagctgcttgcaggcagggacagtgtctcactgatgtttcacctcccactcagagcacacggcagatacagagtaaagggtttgaagatttggacaggtgaatacgggaatgggtgggtgaaaaagagatgccctctgcccttaggctcatgggagtagaatggggaagagcacaaactcccatccatatcaaaaagcaaaacagaaggctgtgggctcgagggggaggtcacacccagtcacaccttggtcatgaaatgacactgccaaggccccttcagggctgtctagcagagggttttccattaagcaatggggcaaaggctgtccctcttcttggcctctcaaggaggggctcctaggacaaaagctacctccccctcggagctcattcctgggaactgctgttctgaagctctgtcttgagggcttgaccagcccccccgcctttttttttttgacacagagtgttgctctgtcaaccaggctggagtgcagtgatgcaatctcagctcactgcaacctccatccaccaggttcaagtgattctcctgccacagcctcctgagtagctgggattacaggcacctgccaccacaccgggctaatttttgtatttttagtagagacagggtttcaccatgttggccaggctggtctcaaactcctgacctcagatgatctgcacgtcagcctcccaaagtgctgagattacagacatgagcccccgagcccggcctgaccagccctttcctccttcccttcctttcctagatcattcgcaaggtggttcgacagatagacttgtccagcgccgatgccgcccaggagcacgaggaggtgactgtagaggggcccctggaggatcccagtgagctggaggtcgatattgattactttatgaaacactccaaggtactgaggcgcccgcggccctgggggacccagcgccatcactgctgccttgctctgccgggccgtctgcatgacacctccctccactcacctctttatgagctctctctccagtctctcttctccctggtgggcagtgtgtctgccacctccgtgtggcctcctttcgatcttctgcctgtgttctgcccgtctttgcgatctgtcctgctttctgtctctgctgctgtctgcaggtggagctgagagggagtggcctacagccggacctgatagagggcaggaagggggcgcagatagtgaagcgggccagcctgaaaagggggaaacagtgaccccgagccgctctccttggagtagcctctcgggaggtaacgctgcccttctcatcccctctgcatggcctggtcttcagtggagtggctgctccctgtctcaccctatcccctcccagccaccccagcatgatgtgggacaaacaacttgttgttgtgtctcgaggcagagattctcacttcccaaccctgctaacagttggctctgaaccccagcttcctcatcaaggaaacagagttaataatatccacttatcagggaccgcacggttttgtaagaatgccttttgggccgggcacagtggctcatgtctgtaatcccagcattttgtgaggtcgaggcaaaaggattgctttaggccaggagttcaagaccagcctgggcaacagagcaagaccccatcacaaaaaaaagaaaaaaaaaagccagaaagaaaaaaatgctctttgaaaagtaaaagcactctgtaaatctaagtggtaatattatcttggaaaccaagcaatggggatctagaaagcagtggacagggcattgaagaggacaggagagttggtctgggctgtgatgcttcaacataagagctccaagactgaggactggactgtctcttgaacctggagcccagctacagttctcaccaggccaaggcttagcttctctttggtgttttgtgaaacacgttgctcccttgctttctaggaaagggctgagccgacaggcctaaggggtggacgacgtgctttctgcaagtcaggagaccgtcagggttggggccggggcctgggctgtggtgcatgtgtgtgagcatggggcagtgtggccacagagcaggggcatgccgtgccgtgccgtgccatgaggaagggacatgaagacgctgtgcgaccatctccagcaggtgtgtgtggtgctgggggcttcagcggccggctctgatctccatcctccctggggcatcctgtactgagctgccccgaggcccttcatgctgcccagctcggggcagctcagtacaggatacctcggggtgggagtcagcaggaggtgagggggcatggtggccccagtgcagcactaaccaggccgttaccattcacaccccagggcctgactctgggaccgagcagcaaggaggctctagctttctgcattcggcaaaaatcagggcccgctgcctcctgagccaccaaaagtgctgactctgggcttcccaatatatctcagcacttgggcaaaaaagaggactggcagatccagttataggataaaattagacctgacacctcagcagcttaaggaggtcaccgtgttaacccctgcactgccaggggtcccactaggctgctggtttagaagactctgagtagctgctgttgggtcctggaaagaacccaaagatgcaaataatgtttaaaagcagcaaagggaaaggaaaagtacacttttctgacttatttttcttatggtagcagtggcggctgtggctttaaatttctctttggctcaggctctatggatgctcctgagtgggagagaggcagcccgaaagccaggctagggggaaggagggagccttgaatttcattttaatttgccgtaagtgatctgcaatgtggctgaagccccccaacctcaggtgattaaggaccggaccacactagcatgggtgtcagaaacacggagcagcctggctctgggacagcacttggccctctgtcagtgacaggcacagggacaagtgtgagggtggcaggggggtggggcggtggggcgagagcagtggtgagggagaggcggagaaaagctcctgccaaagtcccagagggttaggggacagcattaaatgccctaccctcccaaccagggcaaaggctacagagaagacggttgagggcccaaaggcttcctaatttactatccgcatccccgacaagcatgtacagtcgatcctcatcattcacggattctgcatttgcgaattcgtccactcgctaacatttatctgtagccccaaagctggcactcaccgtgctttggctcattcatggacacacacacaagggcagaaagtttgagtcgcccaacacgtgcaatcccagctgaggatgaacaatgccacactctgcctctgtgcctcatactataaataagtgtcctccttgcagcttgtgtagtgccacatttttcacatttttggtttcattgtttagaatggcccctgagggcagtgctgaagtgctgtctggtgcgaagtgcaagaaggctgggatgttccttaaggagggaatggacatcagataagctctgctcagggatgagttagagtgcttgtggtggtgaagtcagtgttaatgagtcaaccctatatattacataaggcgtcttgaaacagaaacgcatttaacacaaagttatgtattcatcagttgaccaaaatattgtggccagaggctcatgggagcctaaccttgtatttcccttaggagcagtggttcagtatttgctaattccgtgttcacagcgactatttatttatttatttatttatttatttatttatttatattttgagagggagtctcgctctgtcgcccaggctggagtgcagtggcactatctcggctcactgcaacctccatctcccgggttcaagtgatcttcctgcctcagcctcctgagtagctgggattacaggcatgtgccaccacccttggctaatttttgtatttttagtagagacggggtttcaccatgttggtcaggctcgtctcgagctcctcacctcaagcaacccgccctcctcagcctcccaaagtgctgggattacaggcatgagccactgtgcacagcctcaaacagcgactaatttatagaacagagctatggcaaatggctgtatttgtttcagagagtgaaagctggagcttgtgagtctagaatcaaggcctcctcctgcttccaggttgtatggccttaagtcatttaaccgccctaagcttcagtctcctcaagggaggatgaaaatgtccctttcgaatgtgctacacttcaagaaaaaggtttagaaataataatggtaactgtgagcactgatgtgaagagagtaaataagaacatatatgctctgggactcaaacaattgcaggtcttgtttgtagtgtgactcggagcaagtcaaatgacttccctaagcctcaggttccttagccataaactagcaataatgccagcatttcccttgtaggatggttatgatggttgctgagtttatgtttgtgaaagggctgtctagggccgggcatagtgactcatgcctgtaatcccagcactttgggaggctgaggcaggaggataatttgagatgagcctgggcaatgtggtaggaccctgtctctacaaaaaaagtttaaaaattagctggacatggtggcatacacctgtagttccagtttcttgggaaactgaggtgggaggatcgcttgagcccaggagttcaaggctgcagtgagctatgattataccactgcacgctagcctgggcaacagggcaagactctgtctctaaatgaaataaaaataaagaatgaaagagactcttttctaagcttttgaaaggtgaggggacccaggagaagaggccagaacaatgcaggagtcctgggcagagtgaggtggcctaggtcctcatctcacccctgctcttgccactgtgcctctagagtctcagtttaccaagggatgaaatgggcagtcatgccagcatgatctctgaggtctgaactttctcttctgctcagtgcctgggcggtaaagtagatgggagatcctagcctgtctttcccaggctgcatattccatgatggtctcttatttgaggagcacttcttggggcaggcaccgtggggagcaccaggaggctgttcttgccctcagtgtttctaatctagtcagggaaatatgcagacatcaaaaagcacagatggacagagacggtaacatttctagagagccaagtaattgtttgcattcatacaatgctaagcacctatgtgtcttagcttttttaaacatcacacctctctaatgggtaggccctattactgccctcattttacagcagagaaaactgactcacagagcaggtaaggcacttgaccgaggtcaggcagcatgggacttgaacccgggtggtctggctccagagttcatgctcttacccactcgactctgccatctcctgaacagaaaaggcagcttttttcttttttgtattttgtatttttacaaaatacaaaagggagagcttccagagtggagaggggcctgctccaggaaggatcaggaaggttttgtggggtggaggtgttgagggcggcaggcagaacctctgcagaaaagagaatggaaggcagccttgacagaagcgtgaccgaaggcagagaacaggagggtagagcgtgttcagaggcttagaggagacagtcagacttggccgatgtgatggcccagcagtgatgaaagcatcttccctctacggtggcagcactgtccacccactgcagcagcagttcctggctttacagttctacagcagcccctggcaaggaacctggcaccaccctcccatccctggggaaccacccaagagctgagttctccctactcccttccaacactcctccccaaccccttcacctggaggacccaaaacagctctatgtctggggatggctccacctccgaatgagctcctgcctccctgtgtcacttcccaccctgcccaagagattgtcacctcctccttattgaagcatcctcctttccccagtggtcccagggcccctgcagatagaacatgagtggctggtcttgaaaacatggagttttcaccccaggttggaggctggaggccccatgggggcaggagaggtttctcactgcgaatcccaggctgaagaatgtgggcttagttcctccagcaaagctgctcttttccagcctaagactcaatacaggaggaggagaggaggatgcatctgcttttcagagatctctgtccatctgaggggcatggggagagcagccagaggcagcggtcaggaagtgctgtgggccagagctgaaggggagctgtcacccttgaggcatgagctcccaaggccagggagcacatccgctccatccctgggttcccaaggctggcgcatggcggacatcagtgcatgttggcagagctgaactgagaaagtgaaggcctcacctagcctcacctagccccttcttggcacaagccctggctcaagaaaaatggctcttcctaagtacaaggatctgctgggggatgtctccccaggtgaccacgtaggcacgggggcctctgcccctctccaagggcacagagcacagtgctctccttggcccatacagagaggcatcctggaacacttgcacactcagaaggaattcatgaggcctgggtggcggctctgaggaacagcctctgcatagggagcaagagaaggagggcggcatctcaggaagtcgggctgcaagtgcagcaccctcagcacatcgccctgcctggggagactgcttttcctgagtcagattcggcctgagctgccagcacaaaactctgtgtgtggggtttttgctggacgttgcacttttgcattctaagtgactccttctctctttgtgtctcccaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggcgcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcacagggctctatctctccttcccgctcgtctttggggggttaggggtgctgaggccagcgtaaagcctgggttgtgatgtgaaggagtctatgggtggggctcaggtcccagagagcccgccaatgcccagtcctcccagaagcctggacaaccctttaatcaggaccacccacctgagagatgcctccagagaggtggcagagtagctttctgttccacctgatggctcccatgagatggggagaagttgggggtctggggaggggccaccacaacccaccagggttcttggccaggcccccagctggcatgcactgagggggccccccagcattccctaggaaggcatctggccccagtactcaatgccattcaaagttcaagaacttgttcttgctgtagggaaaaaattgccctattcctaactagttgctaacacttcctgcaaggctggtcaccaagctgacctcagtttcctcatctctctaatgggagaatggattaggtggttgctaaagtctcttcagtttctcatcctaggggcgccagacaccaacgcctttgtcaggcttggcattaattaagaatcaaatcattggctgcggctttcctgccacataaattcccatcatgaggggatgacggagtcacaatcccaaggcccctggagcaccccagccccaccccactcccagcctctctcctggaatcggacaggccgttcaggccagtgggcaaccgcagcaggtcatctgcagcacccatggggcttttaaaaatgcagtttcagaatcacagttgcctggggggaattgggtggtgacaccgggaaccagaaccaggtctaccagatggctgtggcacgcgacctggtggcaaagccatctcagacgaagacgtagctcttttctctttaaaccaaatttgtagggaatcattccacaccctttgtgagatctttcttgcataacctaaatccctgtgctacagagggtcaacttctgcatgagaaggaatcctgccctgagccttgggtcctctgctccccactgaaaaccaagacggcctggaaacccaggagaagctcagtgaagcagtgcctctagtctcccacctaccagggcggcctctggggagtgagagagcaagccctgcagagcccacgcctggtcaggaagggctctggggccaccaggcacagagaggagcagaagtccatctgtctggcagtcacagtctttcctagcattttacatgttcaggccagtggcatgctagtttccagttttagagaaaaactgcagggaagaatcctgcctggtccagaaatcacccatgtacctggaaagtgggctccaattcctctataccttggttttcctgtttgtaaaatgagagcttcccccaatagagccttgtatgttgtaaaaatttattcgagaaaaaaaaaagcatatgcatgttctgtgattcagcccagtccactgcatcaactactaactgagcaccgacggagtgcccggcacggggctccaccaccctctcagccatcagggatttcaaacccgggcaccacgccagacagagcatggccattgctccagcagaggcacaaatgaggaagagattctgatagggaggtcacggaaggccgaccagaggtggaggcaagaacatgcgtgcagggcggccctctcttcagcctcctgcagttggaggactcacaccccggcactgtcagggctgcctacgccccgcgctgccctcttcccagcaggctcccaccctaggctctcaagccagccacagggacttgcatcccccagaaagcaatgccactcagcctcttaccccatccccgcacttacccccatcttatgccacttaccccatccccgcatgcggaagggaaggaagcggctgcgttctcctgtggagcttggacatgtgcacataaaggggccggcgcagctccggacagtggcctctgagtccagcct

SEQ ID NO: 11748 - DNA, 29121 bp, Human
tctcaggaatatgctggtaaaataaaaataacctttagagatgcccaaactgttttccccagaacaccagcattcattaggtgttcattcaatagattcttcaaaggattccaaaggcaaagaagtttggggaacagtatatataattacccaaccctttgacattagcatactaagggccctgagaagttttggattaagaaagttttcaaattaaagtaacccagaattttctaagattatttgaccatgaaacatatgtctccccacaaagcacatattcctatctccttgaacttgaggataattagacgtacgtgggtagagggtaggggaagggggtatggcatagaaagagcaggaccttgggagcaagaatatctaagtttaattcctgactctgctatttattaactaaccatctttgccaatgttgcttaagcttttttggctacatttttttatttgtaaagtaagtttaataatcactcatctcactgggctataatgataagtattaagtaaggaagatccacatatgtgagttgctggcttataattcacactcaagagatactgattttgtcaattgtcctttcccctttttttctctcttccctccttccattccttcttcccttacctctcctttccttccctcacaccccttttccttccttctttttacatttttttatttaaatgaacttttcattttggaatagttttaggatttcaaaaaatttgcagagataatacagagaatgcccatataccatcctccttatcccacttctttttgtgtctattagatgctcagagtgtgtgcacaaggctggcacgcccagggtcttcctcatggcactaacagtctactgaaaggtggaacagagacaagcctatcaacacctacaagactggtggtaagtgcagtgacagatgcaaaacacagggtgatggaaagccctcaggagggtaacctaacctagatttgagggcccaaacaggctccagaagaaaatgtcaactgagaggaagcctgaaggatgaacagtgggctaagcaaagggttattaatgtgttattaatgggttgaatctaattgggaagggagagaggttgcagagtgaggtgcagagcttggtggacgatgccaaaggaatactgaaacctttagtgtgtccagtctggaactgcatccaaattcaggttcagtaatgatgtcattatccaaacataccttctgtaaaattcatgctaaactacctaagagctatctaccgttccaaagcaatagtgactttgaacagtgttcaccagagcacgaaagaattacaagatttttttttaaagaaaattggccaggaaataatgagtaacgaaggacaggaagtaattgtgaatgtttaatatagctggggctatgcgatttggcttaagttgttagctttgttttcctcttgagaaataaaaactaaggggccctcccttttcagagccctatggcgcaacatctgtactttttcatatggttaactgtccattccagaaacgtctgtgagcctctcatgttgcagccacaacatggacagcccagtcaaatgccccgcaagtctttctctgagtgactccagcaattagccaaggctcctgtacccaggcaggacctctgcgctctgagctccattctccttcaagacctccccaacttcccaggttgaactacagcagaagcctttagaaagggcaggaggccggctctcgaggtcctcacctgaagtgagcatgccagccactgcaggaacgccccgggacaggaatgcccatttgtgcaacgaaccctgactccttcctcaccctgacttctccccctccctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggtgagccctctcctgcccgggtggaggcttaccccgtcttagtcccggggataggcaaagtggggcgggcgcgggacgcgtgcgggattgcggcggcagcggcgcacgcgggcacctgggagcggcgggctgctgcgggaggcgttggagactggctcccgggggctgttaggaccttccctcaggcccgggtgctcagaacgctggaggacttgcttttcttgggccttgatgcgaagtgctgatcccgctgggcaggcggggcagctccggcgctcctcggagaccactgcgctccacgttgaggtgggcgtggggggcggacaggaattgaagcggaagtctgggaagctttagggtcgctggagggggaccccggttggagagaggagcggaactcctggacaagccctgacaagccaagccaaaggtccgctccggcgcgggtgggtgagtgcgcgccgccccgcgggggcggggagagagcctgcagccttcagaacagatattgctcattttctggcagttctcagacgtaggaaataagtcagcaccgaagcagtggttaagccggagggctcggaagaacggcaccttttctttctcgaaaaagttatatgggggctgaatgagcttctggaggcttgtttaccgttttttattgtcacacagaaaaggaaactgccttgtctcccttccgggaattctctctttaagactgtaagtcgctgcctgagtggtttcattttgttttgtttttctgcccttctctttcttcttttgccctttcttagcttgcactcccatggtgatttctgcttggtctcctgctggggttggtggtactcgttcccaccgcacagaacccggcgcctattattggccaagaaacttgagcagcctgttttgaaaagtccctcgctcagaaatgccagcttgcagatggctaatcaaagagacgtggatccaggaggctcatttgagtaccggagcctctgagagtccatggatttttattttattgggccccaacaaagtgccaggcatagcgagagaagtgtttacaaatgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggattctttagaaacttccttggagaaaattaatgattcaagattgagaaaacatttatacaacctcaggccacactcttctctctcttgttattaaccattgcaccactgctatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcaacactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggtgataactatagtcaacaagtatccccatccttaaccccttttgcttctctttctctttccttctctcaaccttcctggtgttagttttctctttcctatttctgagtgtttttactccgacacttacaataaaaaagtttgaaatcccaaaaagttgacaaatttctaaaggagacagaaaaagagtcaaacttactttacaaattaatttgagaaatagctgtgggttgcattttttttttttattgtgcatgaccctgttattggccaagaaacttgagcagcctgttttggaaagtccctcgctcagaaatcccagcttgctaattgaagggatgtggatccatgaggctcatttgaattccgaagcctctaagagtccatggatttttattttattgggccccaacaggttttgtcttgcattatttaggacattggccaggcaatcactggacagccagtttgctctcctttacattttgtagaatggttatcttatggtcaaaggaaagggagagggcctttggaaaataaagctgtgtatttacaagcagtcatacagaatagttttgtggggaaaataaagaacagttatttaatttgtaatttaatcatttttcttaaaccaacccaaagagcataaaatggaatatttatttatttttgtagcttaatttgtaatttaataatttttcttaagccaacctaacgaacatattgggctgtttattttcatttttaatgggccatatttacatcacaaaggacttgagaagtcttacaaatacaataaaatgataaaatatgaattaagacattagcaaccaggatggaaaaacacaaatttgtaaatgatggccaggtttgcaagcaaaaattaaattgataaatggcagcacccccactaccagctatagttagactgatgaaaaatcctctaatgttcatgcctgaaatacagttaccacccttagcagcaaattagaggcaaagaagttctggaatttggacgttgtctctgagtaagctctttgagacactggacaagtaatttccttctgaatactcttatactgacacataggagaagtgtcagtgtttcaaaggaatctctttgaaggctactacattgctttaggggtgccagattaccagagtaaactgccagtttgagagaataactgtttcttaagagatggtctgaaacctaagtaaggaaatccccccacttgaaagcccctaggaagttaattgcttttggcaaattatcttgggccccaaaagtcccttgatgagcacatgttttgtaataggtactaaagactatttacttatgatgaaaaataaaataacacaatttaaaacttgaaattgataaaaagcaacttgaaaccaaatttaggacagtgaacccatccctttcttatttttaaataggtaaatatagaaaaaatgaccacatgatgtgaaacaaaaagcaaatatttaaaaactacatttatactttatctcaccacactaatgtaaagaattttgattttacttataaattcttagccttgtctacacatatacataattgcatgtttaatttgagctatatatagtctgttttttgttcctttgcatgttacacaaacctttttctatttccacataatttttatctcatattttttattggatacattatagagagagcatttattaaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataatttaaaacgataaaaagcaacataattttatatgttgtaccttgtacttccttataaggtacaacactacaatagccttagtgtgtagttttctttttgctatgtatgtatatatatattcataaaagtggaaaaataacatttaataaatcctctttattttctggaaaatccttgctttaaaaaaagtctttagctttttatatagttctacttctaacaccaattaaatatcttcaattcagtctcaagcaggaacaaatcttcagtccacttgcctacctttactgtctttgaagtgacagtgtgagtagtaaagcccaaatcagagagaaattgacttttgtaagattggtaacttcaccttccccggaaggaaatgaggtggttcttccctttgatcacaactgctttcttgatttgaaataaactgttgtacagcccagtcaccccatctttagacatttagaaatggcaatcatagttatataggacaactagcctgagtcccactaagtagaaatgatagtgaatttagtataagattatacctttaggctgggcaggtgactcacacctgtcacccagcacttcaggaggccaaggtgggtggatcatggatcacttgagattaggagtttgagaccagcctggccaacatggcaaaaacccaactctactgaaaatacacaaattagctgggtgtggtggcgtgcctgttatctcagctactcgggaggtcgcggcaggagaatcactggaacctgggaggtggaagttgcagtgagccaagatcatgccactgcactccaggctgggcgacagagtgagactccgtctacaaagaaaacaaagaaacaaaaaatcatacctttagagcaaggccagccttgtgaattagcaaatctgactacaaattcaatcagcagatgtactcagcccagcaaagtgagcaagcttactataggttgtgttaaggcatggactgggataaactggcaaaattagagtaaatttgacaatttgacattggattcattaatgatagcctgtccttcaatgaagtcaggcagcattgtgtttctattcacctctgtgttttgtgaggctataaaaatataagatatgagaaatgtgaatactttttatttgtgagggcagatatcttgaaaaagagagcgagaggaagtcagagtatgcgggtgaagactcttgtttttttgctgaggatttagctttggtttttagccattctcacagagatcattggtcctaattaactggttgttgttgttttttttcatgtgaatgtctgtaaggtttcaggcttgattttaaaaattgggcctatactcacagaaagacaaatactgcatgatctcgtttatatgtggaatctaaaagttttgaatccataaaagcagagagtagaatagtggttaccagaggctagttgggggcaaagttgggggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaaaatatgtacataattcaagacatcatgttatataccataaatatatataatttttttatttgtcgaataaaaataatacaaaaaaaccctgggcctatactgcccacaggtagtggccacaggcagagctggtcccaagcccctccctctctctgtagtcccttatcccaggttgctttattcttgtatgacccacgtggcccctctgggcttgtaagggctctggggctgtattttaggactctatagcccttacattacccatttcctctaccaaaggtcatttctcttatcttcaagcttatttttggaagggtcattatttcttcatgagaagtcaaattctgatttgcaagtgctgaacacagatgccattagtctataaaactcttatattctcacatgtaaatgtagtaacctgctaacctcagattctgcttcctctaacctagttgccctgcaactgtgatgaacctcaaaatcaccaagggtacttccccattctcagagatcctgattccttaggtctatgtaggggccttagcactttttattaaataatgcatcactacaggattctgatgtctgtcggggtcttgagaactatttttctgactctagcactaaactcaaaatgtaatttcagatggaatttcctaggctcattcattttattttatttatggcttggccagtcatggatctaatcagtaacttgcaactgttgcttcaactacctctgtcctggactttccagagattggctttaagaaagaaagaggacatccctgggataagattaccatgtgtatttttatgtacacattttgaaaaacatacaaatgaatgggatctttgcttatctcttccatgtagaaaaatttattttacttctatttcaggttttcaataatgtagtaggacaagatgacatcactatatccctgttttttacacagatatattagagatgcattatcttattggaaattttaaactattcaataataaactattagtcttttagaatttctttttcctcaagtgttgataagtaactgaaagtctacaagcagacaagcagaattagtcggtggaacttcatttcttgctccatttttgtcctcagcagtagagggtggtgagatttcaacccagcctagcaggaccaataagtctggaaagaagtagctctagttcatattggcacctgctaattctagttctgaagaccatgggaaatctcttgcctatttagctcagtgatcatccaagatgggaaattcttgggctcagctgtgagggatcccaagtttatatgtaccactaatgtctcacaaatcaagaatccaagagaatcaagagactatagttcattccttatattaaattcttaggactgccaactgggtggctacagttttgggggctagaagtctgatatcaaggtgccaactggactggttccttctgaggaccacgagggcaggatctgttcaggcttgtagatggccttcttttccatgtgtcttcacattatcttcctctgtttgtatgtgtgtccaaatttcctcttctttttttttaatttagaaatttatactgtctacaagctttatatagctttagttaaaaaaaagcaaaaaaaaaaaaaaatcaaaacaaaaacagtgaagccaagacactcttccaaagtctggacccttccggccttccaaatacaagagctctggaagttgtatataccaaatttcctcttcttaaaatgtcaccagtcacattggattaaggcttaccctattaacaccattttaacttaatcacctctgtaaagaccctatctcctgatacagtcacattcggatgctcaggaagttagggtatcagtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggatgctttgctggtgtcaacactcccctttacaaaaaaaaattcggccgggcatggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggcaacagagcgagactccgtctcaaaaaaaaaaaaaaataaataaaaaaaaataaaataaaataaaataaaaatctcactttctgtttctactgttctctcaagtacccctctgccttctgttacttctttgctgcattctgagaggaatggggtggggagcactctttcctgtagaaccccataacccatctattttcatcaatttatttgaaattcaaagccaggggttaaaatgtccactttcaatttgagatgtctaactttcagataaatctattaacatgcatttctaagtgacttttaagctaagcattttattttattgagctcgtatggaagggtaactattatacttgtataataaagtgcactttcaaaaatactcggttcaaatgtaaaataatattcgtaatattttaagacaaacctcctagaacttatatgtgtctttcttcccagagcagtctctatgggtgcctaaacaatactgcattattagatttttttcagtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacgtttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtctagtaattttacttcaaaaataaaagagaattttctttaccatcaaacaacgttgctgtaatgagtggtgatatatttagtcctagaggaccaaagagaaataaaatggctttgattatgctggtttaagaaaatatatccgattaaacagaggttaatatttgtgatgtttgatttagtaaaattataagactaccaaagaaaactagaagagcaaaataaccaaaatttatataaagaattcaatgttgataattcaaaggtttagaattttttccacctttcaaatactaagttgctgttatagatttactaccattattacccagattttccattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgtgtgttaaaagataatatactgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagactagcctggccaacatggtgaaatgccgtctctactaaaaatacaaaaaattagccatcatagtggtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttgtgcttctttttaaaagtcttttcctgtttgctttgaacttcaataaaaacagggggtaagaaggtaatatgcttttattttgtctgtggggtttttttcttccttcttttggttccttttcagatcctagctcatcaaggccatttgccacactgacactggaataagcctgaatgggggtctatatttcttccagtagttagtttaattcggtcattgagctgttgctctatttgtaaccgtcatgctagatccgagggctgactattcctgagaaagtgtggagatcctttcagactgccatggtgctagggcagagtttcagtcattatcttctgtgtctgctaattcttgcatcatttcttctactctgtaacctggttggctatgaaaagtgattcttcctcactgatgctgcaggcaatgggtgaatatccaattgttctctcaggttcttgtcatcggatacaaagaacaaatttcatgtgtccctgtttctgagaggttcaaagggagcaaatgcacagattctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccaagcttcagggcagggctggcaagttttgccttccccgccagcaagagccctggctttaggggtcttgctacagttttcccagactggaggtcttggggctggattctggttcttagcgaattcttgccaaacacctcccctttccccagtatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtcctgagtctcttgttagccactcttaactgtgaattattggacaaatcatttctcgcactctgtgtaatctgtcacctgggtacttgatgatttaaaccaggaattgtggcccttctcataatactgtctcctaaatattgggtgaatttagtatatcaaggagggcagggcactatacccgtaggggactctctctctccctctgtctctttgcctttctcagatatgcatctttggtggcagacctggggttcaaaccacagttgttttgaaatttctctttccttctccactatgctccccctcactgaaactttaataataaaagtagcacacttattgggcatgtatttgttatgttccaggttctgtgctaacagctttaagtgcattattccacgtattttcacaacaagcctgtgaggaagaggttatttccacttatagataaagaaactgagacttggagaatgtaagtgattttacccacaaacacagggcagtaagtgggaggccctgttcaccttagaacacctggcttctatcattcatggtgctgtttctagtgtggtttgaagaacctgagatccaaactgctatacaagtgacctgctgctttcttggagagagaaatctgaaagacagtggagccctcacattgtctttgcctgtgcacagcagatactgccaattttgggtgggttacacttgtttaccacgttgcttacttcagaaatcaataaaattctcttcatgcttttattttacaggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataataattttacagtttttggttcccctatattatataacataactgagagaaaaacaactatgaaattattttccaaagatgagttttatttatatttatcacgcttatttgatgtggttatggataaatttaatttacaagtgacatgcacctctgaaatgagaagactggtctatttggctccatttttttctaagcaaaaatgactcatttgtgaatatgaaagcttatcatgtcaaaactgattaggatctaccataacaatagtggaactctgaaagcaagagacttctcctcttaagggatatgtctcagcacttcccttcaatcagaaggtctctaagaaagctgtcctggcactgaagcctgcaaaatatatttgcattttgcagctgaataactagacgaataagaaaagcaacaggcagaaaccaacagcttttttttttaaatcaatactttgaagggcaaactaatttcagatcacaaatccttcaaacactggtaaattagaagctaagcaaaatgcaattgtgcaaacatttcttcaactttgagtagagttgaaaaaaggaaaatagcacatgggttcatgtgatagattaatagaacaaaaaaggactgtagtatgtttcatggttgtcctcccaggcttccagcactcaagctgtaaaacaggatgggtcctgtttgtgaaaagattctaccagtctccctgtgcttcatgtccagattttaataaccgttatggaaaaatctcccctataacccaacccatttatacttaaacccatttacacttaaatcttctccaacacgaataaagaatggcgtcctggctttattataacctgctaaacacaatcaatttgctctatgaattgaaatctttgttcataattttaaaacctaaaatgtaaattaaaatgaacaaaatatgctttgcacatcaaactgtcaaggatttttgtctattgctttttcggttttgctttgttttattttaatttaagaagtgaatgtaaattgttacaaacttttaagaaatacatttggatatatgagtcaaaaatttgaaaaaaaattttttttaacttttttttcttattattatactttaagttttagggtacacatgcacaatctgcaggttagttacatatgtatacatgtgccatgctggtgcactgcacccactaactcgtcatctagcattaggtatatctcccaatgctatccctcccccctccccccaacccactgtttatacttgctaagatagcaattaatttatacgaaaataccctgagaaaataatcaaaaataaaggaaaatattgtacacatgatatttcattatcaatatgatgtaggattccttaggtaaattctggaatatttaaagactgaaatagtatgtatcaaagtcatgttttctgatatatttctaatataatcctcaattatataaaccttcttaagtaatttccaactgatctggctggattaactgattctccctgatccgtctataaaatatcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatacagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgacatttttgattaaatgatcaaagaagtcctccccacatcatcatattcaataagaaggattctatggtatactgcacacatatttcatatatacacattgtacatatatatatatacacacctgttatatatatgctcatgcatatacatgtatgtatgtattatatgcataggaatgcaacaaaataacggcaatatctccagattgttgatatatagttttttgtttgtttgtttgtctgtttttttgagatggagtctcactctgtagtccaggctgaagtgcagtggcatgatctcagctcactgcaacctctgccttctgggttcaagcaattctgcagcctcagcctcccaagtagctgggactacaggagcacaccacaacaccgggataattttttgtgtttttaatagaggcggggtttcaccatgttggtcagtctggtctcaaactcctgacctcaggtgatctgcctgccttggcctcccaatctgctgggattacagacatgacccactgtgcccggcctgatacataagttcttattatactttcctgccttttccaacatttctataataagcatatgtaccattatactaaaaaaagtattttaaaatctgattttcaataaaacaactacttattttcttattttaataaattttgttttcatactttggaggaacgaaagaacctgtggtttactgtatctccattataccaaggaagttgtgctaggcacattctgtaagataattcattaaagagaccaattcattcagagaccagtataataccactagcaaaaaataaaattatacttggacttgggttctgttttctttaaatattgctacaatgttatatagccctatgcactatttttgaattttgttctgggaatctccagtttgttttttactattgacagactattatctttacttactaaaatagcatatatatttacatgtcataatttgctcatgtagtaaatattttgttttatcaaaaagaatatatgaagttattaaggaattcatgttcctaggaaacacagcagaaattaattttgctgtataggtgagcagagcagattaaactgcttatatttttaaaactagttataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgcataatatcaaacttctaaaaagttcctaggactcaataggcatttaataaacacctatcagataaatgaattttttaagagaacacattacataatgctttctaatagcaatacagtgacaaactttatttttaaagtaaattaatgcaaatatgtatattatttaaaattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatgaaatttaggcttggagaaaacaacactttgttaaagattttatagctgctcaagatttgaccaaggcttttaaaacttcaaatgttcttttccttattacactgtttcttatcaggatttgtggactttggaaagtaaaatgaaaagtcagagcaatgtgagttagtttgataatctcagtggccagtaacagctatccccactctgaatatataccaaccaacctctcccctttctccaaggaagttagttcttggcaaaggcatttcatgcagtgtactttgtcattctaaccttcctttttttttgtatgctcctgttgctaatcatcctatttctatgggcttcagtcactcttttagcttttgtcttgggagactttctgtctgttgacatgacttttaaaataatcttctcccccattgtatttatatctcattagcctaccccccctccccttgtgttttagaagagttttattgtctgtcatccctctatacttcccaccctgttacctgcccgtgtcctgttcaaacacttgctccttttttccttgggcaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggtaagagtcttaaaatgcaattgaaagaggccaatcttggaatttcatgtagaaccatttataagacaatttgaaattggggcctactgtggtgctatgttgacacacaggaaagggaaggacaggtggctagggtaccgcagaaccaggtgccgagctaactactggtctagacctttatgagtaagtctaggcaattcttccagatataggagaatgagtaaatatgaaccctaggaacagggttcatcagctcaaatcaaaagctcagaaattattttttttctggccttgacttacgcttatataatggtgctcgttcatggccagaaaaattcagaagcctgcagatacaaggacacagaaatccaaaaggtaggtaggaatgctccccctttctttggggatttagtttgtcctgataattccatctggggacctgaattttcatggatatctcaatgtattctaaggacccagattgaagtataacagaagtgtttctagttttgtttgacatgaagaaacctctggacataaagcttttcccatccctattcagcctataaagcaatgtttctcatccctggcagtgcattagaattgcttagggagctactaaaaatgtttcatgtttaggtcccacctcagggcaattacatcagagtctctgagtgaggaccttggtattggcctgatggagtaagtctggggtagagcctaacattctacatttttaacaagctcccaggtgatgctcatgctgccagtccccaggtcaccctttgagtgttaaggctagagactagaggaacaggggagacgtctaagtattggtgaggtttgtcttggttgctgctaaatgattgctggccatttcaacctggggtttcctgttctgtgtttaaacactgactgtattactggtgtcatgctgtgactgttgatataagcagtggatctcaaaaatccatgcagctcctgcccaccattttcatagtctgcttataattagccgctataactaatagtttccaaactgattttctaggcttagaagtggaaataaactgcacccggacccagaataccaagtgcagatgtaaaccaaactttttttgtaactctactgtatgtgaacactgtgacccttgcaccaagtaagttttagtctttctctgattaaaacactagatataacatgagagttatcattttcctagggaagtaacactgactgagagttaagaattagggttctagtcctgctttgcctccaagcaactagatgactgtttgctcatttaaacactggtgaacttcctgtgtaggtgacactttgctggccacttaagctaaagatatgagccagacatatgcctggcatcaaggtatcagtccagaagcacagacagtcaaggaaagcaatggttattgtgtttcaacagcatgagaatagcatcagaagagacttatgttccaggtgttacaaattatacagaaaaacttttcaactctgcctgaggagatggaggtgaagacatgaatgtgtctcatgacttgaatcttgaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgttttatttgctaggaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcttggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtgaacatggaatcatcaaggaatgcacactcaccagcaacaccaagtgcaaagaggaaggtaattatttttttacggttatattctcctttcccccaaccccatggaaagatgtgaagaaaaaccaatcactcttgattagtagaaagtcctttatttaatcttaaagattgcttattttcatataaaatgtccaatgttccaacctacaggatccagatctaacttggggtggctttgtcttcttcttttgccaattccactaattgtttggggtaagttcttgctttgttcaaactgcagattgaaataacttgggaagtagttcacaaagatttgcctcattcttacctataaaaagctaccactttggtagatttatgtattgttaatttcttgcccctgaatgcagccttgagagctgactgataagaacaaatgaaattattcctcagctagtttctgagcaacagttttggggcattgagtggtattctcatccttcctatgaacaggtgttctctgcagcagcagaattggccaaaaatcagaagtaattcttcactattcattgagatctccctatgcaaaaagagaacacaagaagcaaaggcattcccaggaaacacattgcagggaacactttaaaaacttgtacttcactgcctcctcttcctcggcctaattgcttgtttttaattatttctccttcttaacttaaaatactatggggacacatgttatacaaaggtgacttagtagagtcagtagaaaagccaaaattagatattatcataattagtctagaaaaatccctttaagtcattcatcaactacagggtcacaccaactttcagtaacttagaagtattcaattttcccttctcagaacaattatctgtttcttcagttcagttgaagaagaaagtttgccttgcctttagcggttgtttagctgaaaatacatttgggatatttaagcactgtaattgtgctcagagacatacagattcttctatctcacattgactttaatgcatacacctattgagtatgtatgcttgagttatttgtgtgtgtatttcatttctgggcatccatagcaagttgatgttgacttgcttgtcctacggcttctgcatcctgccatagtcttgccgtccacatctttgctggacagagagtggtgcttgccatatggtaagtcaaaagccatctccttgctaggccagcctgtggtaattagatgactaattaagatatgtcctttcactagaacacttgacttagtagtacgaaagttccaaaatcagcggtctcctgcgatgtttggccacttttaagtttcactgaatttctcctttttccttcttatatttctcttagtgtgaaagtatgttctcacatgcattctacaaggctgagacctgagttgataaaatttctttgttctttcagtgaagagaaaggaagtacagaaaacatgcagaaagcacagaaaggaaaaccaaggttctcatgaatctccaaccttaaatcctgtaggtattgaaataggtatcagctttccttgaaaagaaaaatagagaaattagtgatttggctttttgttacttccttttacttttttgtttcttgtttgtttcattttgtttgagatggagtcttgctccatagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctggtctcaaacttttgacctcaagcaatccttctgcctcagcctcccaaagttctgggattataggtgtgagccatcacatccggcctgttactttctttatttaaacattgcttgtgtttgtgggtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagagaaacagcctttaccaggcatgggttcagtatccaagcctgagcaaagagattgctcttaaagtttgtcataagggcacagcttaactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttagagtagttatatttattatttattttaataagtctatatgaaaaataacctcaacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgcttccattttttgctttctaggaaacagtggcaataaatttatctggtaaggcttttatcattttatttcatagagatggcatcctttagagtaataggccaatttcagagtaaaataatgttactaatttcagtgacatattatgggatcttgttatttctcatacaattctacctgctcagcataaagcatttatcaggcagtttgtttaaatttataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcagactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtatttctggttttctcttttttggtaggggcttgctttttggttttgtcttccttttctctaactgatgctaaatataacttgtctttaatgcttcttggatcccttagaaggtacttcctttttaaccttaacccttttagtagttaaataattatttccataggttgctattgccaagaagacctcttccaaacagcacatgattattcgtcaaacagtttcgtattccagatactggaatgtggataagaaagtatacatttcaaggggtaggttttattattaagaaagccaaatgaggattttgaaatattctttcctgcatattatccattctagctacatgctggccagtgggccacctttcttttctgcaatttaatgctagtaatatattctatttaacccatgagtcccaaagtattagcatttcaacatgtaagcatgtcggtaagatagttgtgctttgcttagggttccctcctgtgttatggtctggaaagtgtctttaggcagaaagtctgagtgatcacagggttcactcattaatttctcttttctgagccatcatagtctgtgctgtctgctctccagttttctatttctagacagaagtagggcaagttaggtactagttattcttcatggccagaagtgcaagttctactttgcaagacaagattaagttagagaacaccctattccactttggtgaactcagagcaagaactttgagttcctttgggaggaagacagtggagaagtctttgtacttggtgatgtggtttttttcctcatggcttcacctagtggccccaagcatgacttctcccatgtcaatgagcacagccacattcccgagttgaggtgaccccacggtccagaatcatcctcattctggtgaacctggttctctttgtggtgggcatactgggtaggagaatcacccaaaggtcacccatgagctgcagaaaaaaaggctatttgcagaaggagctcacagatcacattgaaagcattgcatattcaaacatcttggtcttctttattggcatgcccacagggtcttctgacctctgattagatcagacactttttagatattgaatcatcagtttctgtacaactatctgaataaggtatataatcaatgaaatttagaatttttttctatgcttactcctgattggtaatttgtttgggtttagaattctatacaaggccatttgtaattttcctcagcactttaaaaatattaaaccatgttttcttaacatctgttgctgttgattatgtctgctcttggtgtaaatatcattcctttgtaggtaatctgtaattttttttcctctggtaatttttaaagcttcccctactactttcctatgtgttctgcagtttcacaacaatgactttcaatgtgtatttatttttacttaatctatttaataagatttaattagaaaggcagggctttcatcatttctggaaaaaatcccagctattttctctttaaatagtgtttctttaccattctcattctcttcttctgaaactgttgttattatctgttgaagcttcttgagttattttctaggtctcttaattttttttaaaacaataattgtctccgtatgttgcattttaggaaatttctcattactctttttaaattaactgttagtttttactaagcccggctagaatagtctatccactgaggtatgtattttgttttctatatttttcattcttaatgtttcttattgttccttttacatttttacttgtatatgtttcattcctgctttttttaattttctttcttctttctcttttctctctttttttttttcttcttgcagtgcagacagactttattagtacagcagaggtgcccacagagcaggcagaagggatcagtgcctggatctgtcccttcctccttctgccctcgctgagccctagtgtgtccggaattggtgggt

SEQ ID NO: 11749 - DNA, 144596 bp, Human
  misc_feature (1)...(144596): n = A,T,C or G
cttgggaggctgaggtgcaaggatcgctttagccccggagtttaaggttacaaggacctatgatcacacttctgcactccagcctgggtgacagcaagactctcaaaaccaaacaacaacaaaatatatatatagctctctaggtttttatgttaaatattagagtgcctaagaatgtacatggttggcagaggatcttgcagctcatagtgataaactttagtatttacataaaaatactagatagctagtagattcaatgttctgcttctgaaaaagatatatttttggttttgccttttagtgaatttcttttggatgcttaacacaatgttaatatagttacaaaccaacttgctaatatttggaaacccacttaaaagctatcttcatttcatatgatgtgatttttaagattttaaatttggggctgagtttgtatcttaataattaaggctgcacacattgacaactacaaaataatgcctgggaagatgagtcctgaggctaattttatatttatgtggatgagtgtggagggggataataattctgaaatacttaatcacagacctaaaatgtagatctatgggtaattttaaatgttgcctgtcaaggcttaatagggacttgacaacagctaggatggaaattatttcaacacttaaatatgcttactttgtgccggacgctgttctaagtcttttacaaatatttacttgatatttgtattttgtgtactattttgatttctgcaacattattaggcttcatactcttctgtgggaactgggttcaaatggttccagatgaaaatacaaatagtcctgtgattagttttgttctacatcttatgacagatacttcatgaaaggaaatatgaaaaggccacatcttgctttgaaataagtgagatggagcctctccctctttttactgttaatgttcatagttttaaaaatcctagaattttgctgcttttcaaaatgttaagttggaaagcaagaataaaatgacccttttttcaaatgttttctgtaccatttattgcattgtttacattttatgcatctcatttctaaatgaactcatggtaacagagactgtaacacttttgcatcaccggaatcttctaggtgtgtaaaatgatggacgagtgaatgaataaatgggggagtggttcagagcttggaatggcgctatgaaggtggtgaagtgacgtccctaccccctcaacacacatataaaaattatgaatttataaacattttcctcttgatgtaatttttcaatggagggaagaggataaattcatagttctggcacttacatctggaattaggctacacagtctacgggaagcaagttaacacagtctaacagatgcacgtgaatttcatgctgggcgaagatgaactatgtggaagatgacttataaggagcttttatgttacatcttggcagttaacacagtctaactgatgcacgtgaatttcatgctgggcgaagatgaactatgtggaagatgacttataaggagcttttatgttacatcttggcagttaacacagtctaacagatgcacgtgaatttcatgctaggcaaagatgaactatgtggaagatgacttataaggatcttttatgttacatcttggcctgaggttaggaaactaaagatgacaaaggcactgttttagtatgggttttctggtttcgcttttgtcgtgggggcggggtgggatagtggactcgtaccctaacaaagacccactcgaggctgcgtgtcggcccgggggcagcagggggcaggagaagctggctctagaccacgcgttccttttcacgtgaccagtcgctctctttcccgtggcggccctgcttccggcaggggcatcacccggaagtgggggtagtcgagggagggaggggtaaaggcggctggccgccgcggcggggggtgggaaaagagaagcagagggaggagttgttgctgccgccgccgcagccgcagctactgtgacttctccgattgtgtgagctttgttggagcctgcgtacgtggatttatcgctgccacggtctgcgtagctccagaggtttaaccataggatagagaaaccaggtaagtcctacattggcttcccgtcgtcctttctcctggagggggtcttctgtgctgtcagtttgtactacgagtgtggtgagaaggtcatgttagtctggggcagtctcgaaagtctcacttattcacaattcaggtattaactacatttatgttttacctcccctaacaggggatagaggaggggaaattaaatcctgacctgtgtcactttcttgtaccctcttggagagaatgtcctgatcatccatggcctacgttacccaattaattgagggtacaagaaagtttgtgtttggcattgaaagtcacatggactggggtctttgcttagtgacacctctttatactttggaagctaaggttactaaaatgaccataattgatgaaataataattgaaaaatagatatttggcttcttgtcttgctctgggagcgtaaggtaaactgagagaactcttgtttccacttagttttgttcattgtgccccctttccagtaaagttactgtccattgtccgaccctgtggcatcttatctttgacacttttcttcgttgtagacgttgagattatcttaagcacaaacacttatcgtttcacaattcagcgtttgtccaggatctgatctttattttaatcacagactctttatctacaatagtatggctttgtattgagaatatgtgcagaacattgaattagatgatactgaggttattaatttttttttttttttgccgggtgcgggggggtggtggggagggggtgatgcacaagaaataagacagagttcctggcctcaaaagagtttacttacagtaggctgggcgcagtgtctgacacacctgtaataccaacactttgggaggccgaggagggtggatcacctgaggtcaggagatcgagaccagcctggccatcatggcgaaaccctgtctttactaaaaatacaaaaattagctgggcgtggtggcgggcgcctgtaatcccagctagtcgggagactgaggcaagaggatcgcttgaacctgggaggcggatgttgcagtgagccgagatcgtgccactgcactccagcctgggctacaagagcgaaactgtctccaaaaaagaagaaagaaaaataaacagtttacatacaattgagtccgaattgagtcagttgaattcagctatgaagacaacggtttctagcagccccactgactgaattactaggttgcttatcacatccttttcaatggttatttttgaactggcattttattatatttaacattttctggtgtctaaggtcatgacatgagagagttttttttgtacttgaggatctcaatgtagtaggaaagaaagatacacgattacctaaacatttaaaaaatctcactaacgttatatattagaaacaggaggtgttatgagagtgcagggaagggagcatgtgaactgggctttgaaaaatagataggatttagctttgcaggaatggaggaagaggaagacatctatctggactgatagatagaagaaataatgtgagcaaagccatgggggtctggaaagttgcccgacatccagtaacacactgtaagtcaatattcctatttctaacagccacatcttccaagatgtcactgattaaaattagaaaaaatatagaatacaaaactagtcagctcacaaacatatccaactgccctccagccaataagaaagcttatatagagaaaaaaatacatggaaatgacaaaagcaatgttaatgtatgaggcttaattctgatgtaaactcaaatctaaaagagaaaaaatgtaaaactcgctatactttaattctgattgagtgttgtgccttaaatataatttggaatcatttttaaaattgttgggaatgaataacattttctgaagtgagcaactgttccaggttttccccaaggaatctctgcttttccttttttcctctaaattgatttctctctattgatcttcttaacttgataggaactattctattccgatcacagccttagaaagatcttgatgcctgccctcaagataaggttaaacactaatccctccaaaggataggttaacatctctgttctctaaagcagaaggttgattttctttgaaaaatgcttgcagaagcagtaaaatttgcttacaaaacaagagagagagagaaaagagtgcaaaaataaccccagctaacacaccacaaccttcacttctgtgagggcgctaaaggaaatacattttaaaaaaataaattccttgttataactccttttatctatatatttaaaagctcttggcaaactttattaatcaagactttggacatcctgatgagtgaaaataatcttcatttgccagttgggaaagtaaattgcaaggagagatttttgtctgaactcatagaagcactagcatagatgagaatagtatttgggagttttgtctcaaaattccttctattcatctttgttaaagggcagttcaggttttagcgttttgtttttagacaacgatatttcttaggatatagctcaacatggggccggggcaagggggaggctgggggacagatgagtgataggcaatggttaggcagagtattttagttcactctaccatcccagcaatcatgtttttccctcttaaatctcagtcttcaggttgatttaatgtgatattacttgcttacttaacttgctgagatagtttggcaggaaaaatatcaaaattcctttagaatgtgtttcattaaagtaaaagggtcctgtgtttctgattttataaaatgttcttactttttccagcactgtttgcaaattgaagtgatttcctaatctttttgtgcccaaatgtatgagatattggtagactacatcagttttcacagatacctctttccttgaaggaaatgagggtaaaataccccattttgagtcagttatgtgtactttgtaccatattttctgttcacatttaaaattatacagctatgtctcaaggatgaaaaaagagttttacttatttttactattaatctctagtgtagaagtccagtttttcagacctataatcaggagtgcatttttaacaatttaccagttgaaataaatgggttatttcacattgtagggatattgttttagactggccattaaccttattttattttatttttattttaaaagatgttattgttattatttatctatgtatttatttttagaggcagggcctcgctctgtggcccaggctagggtgccatggcacaatcatagctcactgcagccttaatctcctgggctcaaatgatcctctggcctctcaagtagctggaaccacaggcgcatgccaccatgcctagctacttatttattaattaattattattttttaaataatattatttttaagagatggggtcttgctctgtcacccaggctggagtgcagtggcgccatcataactcactgcagtctcgatctcccaggctcaagcgatcctcctacctcagcctcctgagtagctgggactataggtgtgtgccaccactcccagctaatttttaaactttttgtagagacagcatcgtgctgtgcagtggtgctatctcggctcactgcaacctccgcctcctgggttctagtgattctcttgcttcagtctcccaagtagcggggattacaggtgcgcgccaccacacttggttagtttttgtatttttggtagagaaggggttttgccatgttggtcaggctggtatcgaactcctgactgacctcaagtgatccaccctcctcagcctcccaaagtgctgggattacaggcatgagccactgtgccaggccttaaaacacctagtgttaaaaatggtgtcttaattgtattctcagattctcctagaaagaaaagatatactaaatgtatatttagatatactaaaacacctaatgtttatttttgtttatttatttttgagatggagtctggctctgtcacctaggctggagtgaaatggtctatgtttgttttttcatcttgacagtaatatctttgaacattttctggagtattagatattattctcttgatgcttcaaggtatcttaacttcaccattgtattgcgatatattgttttggagagacagtataatataggattaagagtggaggctaggtggggcacagttgctcacgcctgtaatcccagcactttgggaggccgtggcaggcggattgcttgagcccaggcgttcgagaccagcctgggcaacatagggaaaccctgtctctacaaaaaatacaaaaattagctgagtgtgttggcacgtgcctgtagtcccagctactcaggaggctgaggtggaaggatcgcttgagcctggaaggttgaggctgcagtgagctgagatcacactactgcactccaccctggatgagagagtgacagagtgagaccctgtcttgtccggaaaaaaaaaaaaagcctgtcttgtctggctcagtccaggtgctagactgtctaggtgggatcccagcccctctgcttactacttgtatgaccctgcgcagatttcatactcctctgtgcctcagttccttcaaatttctaaaatggggacaataacagtacctgtctcacaggattgttaatgatctaatacatgtacggtgtctggcagatagtaaacatacaataaaatgtagttacctttaatattttaatatattatttactgtaaaagtaattttaacatcctatataataaaattataaattacagttttgctgtactataaatttagtagactacaggatcaatatactaatcaatcaatacttgcaagcaatatttaaattctttaaaaaaattttttttggagacagggtcttgctccgtagcccaggctggagttgcaatggcacgatctcggctcactgcaacctctgcctccagggttcaagcgattctcatgcctcagccccccgagtagatggggttacaggcgtgtgccaccacacccggctaatttatttatttttagtagagatggggtttcgccatgttggccagcctggtctcaaactcctggcctcaggtgatctgtccgcttcagcctcccaaagtgctgggattacaggtttgagctaccgctcccggccctgccaccacgcccggcacaatacttaatttctaacttacaccatagaaaattggccggtgcggtggctcacgcctgtaatctcagcactttgggaggctgaggtgggtagattgcttgaattcaggagttccagaccagcctgggcaacaaggtgaaaccccatctctacaaaaattacaaaaaatagccaggtgtggtggcatgcgcctatagtcccagctactggggaggctaaagtgggggaattgcttgagcctgggaggttgaggctgcaatgagctgagatcatgccactgcagtccagcctgggtgacagagtgagaccctgtctcaaaaaaaaaaaaaaaaagaaaaaaaaagagaaagaaaatggaaaactcagattgagagggtcccccagtagcctatagtacacctacatatgctaacatggcatcttaaagctcattattacagctggcaaatcaaatcactgtgatgtgctcatcctatttccctatcaagaaaactcataacaatctgcttctgtaattagtgagccacagactctaggccatcgagattttccacattccctaattgtcaaatgctgaaccatacttgtactgaataagttgtgatacagtgtaagcaagggaaaaggccttatgtatgtctaacctactctgcaaatagctgcattcttacaaagttgtgtgtaaattgaatttttacaaagcatgtcagcactttgattagtacatttttattgtgtgcttattgcatattcagtgtttcctgtgagctatacaaagaagcataaggcatatgttccaatgtctagcaagagaaagaagtttaataccaagcagagagaaattaggtactactaaactatgaaactgattccagggtattcggaatttaaaaagaaagtggctaggagtatttgacatgatttttcatgaaggaggtgggacttcagttcatttacttactcaacagtgatttattgagtagccaccatgttcactggtggtatgatagtgaacagagcagatatggtcctgtttctgtggagtttacagactagtgaagtaatagaacttaaatatgtgcaagaaaacattctaggtgaggggaccagttctaaacaaagtcatagaaataaatgataagagcatggactatatggcaatcagtgaagggacttgcttgattgtagtagagattttatgttggggaggagcactgcaagtgatagatgcagaccatcttttgaatgctttgaagaactatttaagtctgtctaaaagtcctttggatacactgttctggagagggtttggggctttggggtcatactgccttggtttgatctcatctctactctaatttgtttaagtttagaattttatagtaagttttctcagtgacacaactctataggcaacaaactgatatttacagagtggttggggtcagtaacccttgtatcagttaagcaatgtacacatgaagtgccagtaggaagtccaaggaaaggttgggagaaataaaaggaggttagtaaaggaaagagaaataaatacattctgtgatagttggtagaatgtcatcagaaatgtcttcaagcaaaacaatacatttgcctgtcttttgtttctagttgcgtttaatggtagtgtgttttccttgtctaaatatgagaaagagaaactaaactgcagctacttgacgtgggcatctgagagctaccaatggttggcttaggttatgttctacatttgaagcatctggtcagttttagattgtcttctatatttgaagcatctggctagaccacttgtgtcccagttttctattttacctaaactcaacttggtcagaagcttatgtagtaagtattgtttgtaacctgtgttagtactctcttaacatggcttaaagcatgaatggattgtcaaatgaatacctgttatgacctgtattttttcttgttacctttggatttaatgtaagtataataatgctctaagaacatttgacagtattgttcaggcacttttttttttttttttttgagacagggtctggctttattgcctaggctggagtgcagtggcacgatcacagctcactgcagcctcaacctcctgggctcaagcaatcctcctacttcagcattccaagtagataggaccacaggcatgtgccaccatgcctggctaatttttaaaattttttttttgtagagacgggatcttactttgttgcccaggctggtcttgaactcctgggttcaagtgattctcctgcctcagcctccccaaagtgctaggagtacacaggcatgagccatcatgcatagctgcttattcaggtgcttttaagaaattttttccaccagaaaagtagaaatgatcataccagactacctttgtctcctcccaatcttttattatggtgatgtccaaccttgttataaggaggagcttcttttaatctcagagtcatgagatcagggcagatactgacagtatagttcctgagaagtagttgctggctgtgctgttcttcctttcccaatgggaatcttagctgagacatgtagcagagagaagacattatggggagccagcatggagctttataggaggtgaggtgtctagatctaccagtagatcccgatttgcaggtttgagactcctaccttatttcatccatggctgttgcattgtacaaatctagtgggcagcagccacagtctgtaaaaattatgacatggaattacacaatgtggcagccctggaaactacccaaaccacttctatttctagtcctgtattcccttcaatacctactacatccagcagccgtgatagtcccaacacgtttatcatttgactctctttgcctcccacttgaaggctcccctttaatccaacagataaaaattacatctttgtctaaggatttcaaggtgttgcataaattttcttattctatttaagtatactcatcaagaaaatgataataactgcctcgtctaattcataggtttttatcagtatcaagtggaataatgtatgcaaaaacttcataaattaaagaatactacacaaatataatattcttttcagatatattatgttgtggaaagaatactgaattccaatcagatgtctggcatctcagttctttctgctattaacaaactgtgactttggacaaattactttgtgctctggggactttgtttccttacctataagaggaaacttataatgccactcctatctacccagacacctaagagctactttttcctcacctccacattcagtcaccaaatttgttgtctagttcttaaaatttcttaagttggtcctgccctctctatctccattcagttcctaatcacttcccttttgggcagcagcctgttaaaaaaaattgtggtaaaatatgcataatataatattgactattttaacctttttttttgagacgaagtctcactctgtcacccaggatgcagtgcaatggtgtgatctctgctcactgcagcctccgcctcccaggctcaagcaattctcctgcctcagccccctgagtagctaagattacaggcacacgccacccctggctaatttttgtatttttagtggagacggggtttcaccatgttggccaggctggtgtcaagctcctgacctcaaatgatccacccgccttggcctcccaaagtgctgggattacaggcgtgagccactgtgtccggccccattttaaccatttttaaaggtacaagtcagtggcattgagtgcattctcagtgttgtacaatcatcactgttatgcatttccagatttttttcatcatcccaaactgaaactctgtacccattaaataatagcttctcattctgccttctctcaccccctggtaacctcattctactttctgtctctatgaatttacctattctaggtactttttgaaaaataatttcaacatttatttttgattcagagggtacatttgcaggtttgttacctggctatattgcatgatgctgaggttggggtacaattgatcctggcaatcaggtacagagcagagtgcacaatagtttttcaacccttgccccactccctccccacccagtagtccgcagtatctattgttgccatctttatgtctatgagtacccattttttttttttttgagacggaatctcgctctgtcgcccaggctggagtgcagtggtgtgatctcggctcactgcaagctctgcctctcgggttcatgccattctcctgtctcagcctcccgagtagctgggactacaggtgcccgccaccacgcctggctaattttttttgtatttttagtagagactgggtttcaacatgttagccaggatggtctcgatctcctgacctcgtgatccgcccacctcggcctcccaaagtgctgggattacaggcgtgagccaccgcgcccggctgagtacccattgtttagctaccacttataagtgagaacgtgtggtatttggttttctggtctgcgttagtttgcttaggataatggcctccagctgattccatgttgctgcaaaggacatgattttggtctttttttaatggctgcatagtattccatggtgtatatgtaccacattttctttatccaatccaccattgatgggcacctaggttgattctatgtctttattattgtgaatagtgctgcattaaacatagaagtgcatgtctctttttggtaggacaatttattttcttttggatatatactcagtaatgggattactgggtctaattgagttctaagttctttgagaaatctctgtactgctttccaccacggctgaactaatttacattcccaccaacagtacctaagcatttctaggtacttttaataaatggaataatacaatatttgcccttttgtgtctggcttattttacctagcataatgtctcaaaatttcatccatgttgtagtatatgtgagaatttctttcctttttatggctgaataatattccattgttgggtaataacgttttaactggtcctcctaactccaggctttgccctatcaaatttgtccttcgtgatctgaccttacttacctttacaatctccttgttgttaccattcatgccatatgcctcagccataccagtggtggtccttaaatatggcatgctgtttgacaactctgtaactttattcatggctcttttgtctgaaatttatttccattcttctggagaactcctactcaatcttcaaggccgtttacctaacaatagtggatgggtgaaattatgatacgttcatatagtggacttctagtcagccttttaaaattatggcatatatattagtggttaaaagcacaggctctggaccaggcttactgggatcgaatttcaaatctgtcacttactaactatgtgaccttgggaaagttccttaccctctctgtatctcaattttttcatctatgaaacagggatagtaattgtatctatcccatcaggttgctgtgaacatttaattacttagaagtattagctaggccaggtgcagtgcctcacgcctgtaatcccagcactttgggagtcccaggcggatggatcacttgaagtcaggagtttgacaccagcctggccaacatggtgaaaccctgtctctactaaaaaatagataaaaattagccaggcttggtggtgggcacctgtaatcctaactacttgggagactgaggcaggagaatcacttgaacccaggaggcggagggtgtggtgagctgagatcacgctactgcactctagtctgggcaacagagctagattctgcctcaaaaaaataaaaataaaaataaaaatattagctattatgttttatttatttgttagtttttaaatttttcgtagagatggggtctcgctatgttgctcaggctgatcttgaactcctggcctcaagaagtcctcctgctttggcctctcaaagtgctgggattacaggcgtgagtcactgtgctcggtcaaaagtattagctattgttatatattaatatttactgtcatagaaaaatgtttattatatagtgttaaatgaaaagaaacatgctgtaaaatagaatagtatatcatttttgttaaaaatgtgtgtgttcttgggtgtggtggctcacgcctgtaatcccaacactttgggaggaccaggcaggagggttgcttgaggctgggagtttgagaccagcctgggcaatatagggagacctcatctctacaaaaaataaaaaattagctgggcatgtggtgcatgccttgagtcccagctactcaggaggctgaggtgagaggattgcttgagcctaggaagtcgaggccacagtgagctattactgtgccattgcactccagcctgggcaacagagtgagatcctgtctcaaaaaaatgtgtgtttatatgtagacacacatataataccctcctagacttacatacacacaccccaccccaccccacatacacaaccctcaacatgttagccttcattatttctcagtgatagaccaattggttgtttattttttatatttgcttatctgtatttcctgtttttctccatttgacatttatttcttacatttggggagcatgaaaaaagacacagttaaagcatctcttctgtgaagccttccctgatttcccttccttcgtcctttagggcaccagaataccttgcatccctgaactccttaaagcctgtattatattcatttacattttaatccccaactgggactagtgcagagcctaaaagatacatgaacttagccatattagtaaggtgaaaatggaattatgtgcaagcactttacacatgttatctcatatacagcactcagcagtctcatgagtaagagttatctgtgtttttcagatgaggaaactgagcatcagaagagaccaaacaatttgctgaaggtatacaacagtaagcaacagaatttggattcaaatccaagtctgtctgatgccaaaggtggtcttttcaatgtatattgaatgactgaatgatctaatgaatatatctgctgtctcagatgacataatttatgaaagacttattggtaaacaaatatgctatatgaatgtaaagatatgttgttgttattttctgctatattttcatctgcaccctagattctgactaggcaaatgagctttccttctccccatgcacaattttttccctctgttagtataaattggcaattttggctctccatttgtctttttatactgcccatgctctttccactctttaggaacctgactcataattatgatattaagcttttcagattaatctagccatgtccatcagatttactgttgtgtgtacatgttgagaaaactaattagaaagtatctggccagatacaatttgtttcagtgatgccaaagtatggtaattcctagtttaatgtgtttacctttttctttttttttctttctttctttttttttttttgagacagagtctgtttacctttttttgtgtgctgatatgtccacatttaatttcctacattcatattcataccgctttcaaaagaaggtgttgtcaatgataaaacattagacagaaatagtttttagacagaggatgttaataagttcagcctatgtcttatttaggtttatgtttttgtgtgtatgtgtgcacagccttcatcatttaagtttatgttttgtgtgtatgtgtatgcagccttcatcaaaagaaaaaaggcagatagtcaagaggtgttttaataatttatatcacagctacaacagaatatactaaaccaaaatttagaatttgattatagcttgactccctacaattttttcagaattaaaaagatgaatcccctttaaagcaaactaactgaagggaagcatctactttgtgaaaattgcctgtctaaaatggggtgggaaataactcccttttaagtaccgcacttttttttattctaccagaacctggtttctaaagatttcaacctatttttatagtctcagttttgtgagatgacaaagttcatcttagtgatttctaactaagaaagcacaaccacagaaacgaggaatggattctggaaagggaaacttcctgcaaattatgatgaatttacagaaatagtaaatatttaaattccataaatagttaatattgttgttgataattatttgtcttgatttctgttcaagaagtatacatttgaattagcacacagtttattttattcctagcaatttagtatatttttcatagccatcaatatttgggattctgcttgcttatgattacaaatcacttgaaacctgccagttgaaaattctcaagggtgtgaaatgatatgggccttcagtgaattcattcccctttatctgtataaaatacctggctaaacagttgtctttgacaattttaaattactgtttcctttcttaaaaactcctttccagaagctgatctcccgtacatttccagtacataatttttcatccttatctgtcctgacagtgattcagctttgaataagagagaatgttaccagagtttcacctttattggcctaagtctttgtttattttttgagacagagtcttgctctgtcgcctaggctggagtgcagtggcatgatctcggctcactgcaacttctgcctcccgggttcaagtgattctcctgcctcagcctcccgagtagctgggactgcaggaacgcgccaccacgcccagcttatttttgtattttgggtagagacggggtttcgccatgttggccaggctggtctcgaactcctgacctcaggtgatccacccacctcggcctcccaaagtgctggaattacaggcatgagccactacgcccagccagcctaaatctttaaaacaggacatgaaaggaattgaagggttgggtatgggtggggttgtagatctagactatatttatggaatgtttgcttccttcgtgctgaaaattgttctttggaccttgggatgaaaagagaaaatatatgaaaaataagaatgttatgaaaagtctaagtattctgaaaaatacattagtatactactttataatcataccatataaatatttcagctataaaaattaatgcaaaataaattttctcccaatatgttaactgctttaaaaaaaagtattggcaagattgattatattctttcctaagaggaaagataactttgcataatcaccaagatggtttaccaacatacaccacgtatactgagtattacagtcttcaccaacatgagtcaaatgctagcgtgtatagggttggtagtataaacctacctggtacctttttggttttgctgactaaatggtgctaatgaagccagggttatagacttcatctctgtgggagtcacttgttctttggagtcattaggtatgccactaactctgctccacagttttccgaatgcagtttgttcattaagaaagggaggctagtacagagtaaaaatagctcagcaaaaagccatcatcagtacccatgcccttagcctcctgatagggggaggagggtctttaatgtccaggctttcaaactcacatatacatttttattattaatcagtggaggctgcacttagaaatttatttctttggacttctgcaatattctgcttataaagtgtttctgtggtttcaactgtagatccctttttgcctttatctccagactcttttgtctcaaaactttatggtctcagagaactaaggaaagacttggctcactatatgcatttgcagaaagtaataaggctttttttttttttttaacgccataaagtgatctcagcaaagtgacaaatctacagtttcagaactgaaactaaacaactctttcgtggtttattagactcttctatattaagtagagcagttttaggtgagcctctgggaatctcatgaaactgagcttccagtgtggctcatagtcgtttgtaatctatacaaatctatagtatctttcattgagtatcattaaagaatgaggtattttgcagaagtgaatttccaaataactgaagtataccctttacatttttgtcattcagggatctgatgcatgcatcctacaaaggcatccttgaaatacatttacttttccaaaataaaaatacttttatttctgattagaacattgataaatggtcaatgtaaaaacaaaatctagtcaatatttatttatttatttatttgagacagagtctcattctgtcgcccaggcagtgggggcaatctcagcccactgcaacctctgcctcccaggttcaaatgattctcctgcctcagcctcctgagtagctggggcaacaggcgtccaccaccacacccggctaatttttgtatttttagtagagacagggtttcgccacattggccaggctggtctcaatctcctgacctcaagtcatccacccaccttggcctcccaaagtgctgggattataggcatgagccaccacgcccagccccagtcaatatttagatatctctcctttctgagatttattttttcttacagcatttatcactacttgacttttgcaatttttttttttttgagatggagtcttgctctgtcacccaggctagaatgcagtggcgcaatctcagctcactgcaacctccacctccccagttcaagtgattctcctgcctcagccccccaagtagctgggattacaggtgcacaccaccatacccagctaatttttgtgttttcagtagagacggggtgtcaccatgttggccaggctgatcttgaactcttgacctcaagtgatcctcctgcctcagcctcccaaagttccaggattacaggcatgagccactgcgcctggctcactacttgattttatacattcctttgtttgcttattgtccatctccctcaagagaatatgagccccatgaaagaagagacagtgcccctcttcactgctgtatcaccagcacgtagattagtacctgaaacataatgggacttcaataaatatgtgctaactaaatgaagaaagtagaaatcactcttaattccaccatccagggattagccactgttaagattctggtatcatttctttctttttttttcttttttaaagagcaaccctattaactgatctggtatgatttctaacaaaagttttttctcttacatacacattctcatgtgtatatataaatttatacaacattttaatagaaataggactatcgtcaattgtttgtagcctcttttttcacttaactcatcacagacatgatgtcattaagcaaacaattatgtgtttttaatggagatatgataatatatttgaccaattctgtattgatatttaggttggttccagtttttcaatcacataaacaaccttgtgataagcatccttagccatacatcttagtacagttgtctgtacctttcctcccctttgaatatattcttagaactggaatttctgggttaaaaggtatgcattttttttattatactttaagttctagggtacatgtgcacaatgtgcaggtttgttacatacgtatacatgcgccatgttggtgtgctgcacccattaactcgtcatttacattaggtatatctcctaatgctatccctccccccatcccacaacaggccccggtgtgtgatgttccccttcgtgggtccaagtgttcttattgttcagttcccacctatgagtgagaacatgcggtgtttggtttttttgtccttgcgatagtttgctgagaatgatggtttccagcttcatccatgtccctgcaaaggacatgaactcatcaaaaggtatgtatattttaaggctttttttgagacggggtctcactctgtcacccagactggagtgcagagcttcaattatggctcactgcagcctcaagtgatcctcctacctcagcctcacgagtagctgggactacaggtatgcaccaccacacccggctaatttaaaaattttttgtagggacagggtcttactatattgcccaggctgcctattttaaggcttttgataaatattgccaacttgtcttttggaaactctgtagggattggtgttagtttatactaccatcagcagtatatcatagttcgttaactcaaaactattttgatattaatgattttgaaaaaaaagactttctaaaacacattaagtatttttagtgctttattgcttttctaagcagaatacctgtacctgatttaattataacacacatacacacacacacactcatatatatatatgacatgacatgtgctcgacctgttattgctcactgtccttgagttgagagtagtgttcttccttctaccactgcctccatggggcagagaggtcctttccagagctgagaatgtcagtaagagatatatgttccttggcatcttgacttcctaattggaatttactatatgtttccccacacgaaacagtgttatagcactattaatatatagtccaactgtgctattgtctaaactcctaagaaatggacctttgaacctagccatcatttataaagttgttcttatgagaaaacatgtttcatcttcaaaattgagaaacaactgttcaagaaacccatttttaaattgaaggtacacattcaaaaagtatatattgagggcttattgtatgtgtgaagataaatgtgctaggccgtcaatgggtaattcttttcttgatgatgcaatgttaaggtacccctgccccctagtcatcattttggtcaggtcaggacaaccagttgcaattgtaacccagggagaaaatattactggagtgtgtttgctaggcaggggaccacgtacaagggtttctgcagaactttggaggccaggattgaaggaatagctgctcagaagaggtagaagagaaaaacatacaggaaatggtaaggaagtgggaaagttggaaagattaatgtgtttcttttagattaaggggagaagagggtactgtttgtcttctcgagatgagtgaggatggacattcaggctgacattctgccatcaaaatgccttgtgtaggaatattagtctttgcatataacttaacaaagctgacctgccattgttgtgtttttgcttgaggacagtgccacactgctgctgccatgtacccaaagaattgcttgaacccatccccttcattacttcaactctaatgactattacttttcattaatttaggctgtattcttttcagacaacgtaaggtaggggaaaagagcctactttttggaatctcagaggcctgagttagagtcagattctatcattcattaacttatttgtattaggcaaaggagctctcactatgtcttcgaacttgaatcttctctagaaggagaaaagttttatgtgattattaggattaaagtgtttaaaatgtctggagtatgataggaacgaaataaattttaatttgtttcttttctttttctttttttttttttttgagacagggtctcattatgttgcccaggctggtcttgaactcccgggctcaagcaatcctcccgctttggcctcccaaatttctgtgattacaggcatgagccactgtgctcagctaaatcttaatttcttttattctcctctcctccacctcattttccacccactaccagaatcatcttctattttaaaaatctgcgtctgaaagaataacattataaaagtagtatattgaggttaaacgtggccacctggccatatgtttagctctcgtccttcacaaaactccattaatgtgacagtgaaaagattttaaaaaggttacacctgcaaggaaaagaaaacaggagagctaaatcagcagagggatgaatttaatatatttttggaagataagaagcacatgaagagggagaaccttccagcagaggaggatattaatgagaagtgagctctttaatctcacattacccatgataggctcagaatttgaaggtaagttgtttatcctgaaaggtgaagaagagacccagggctgaaaataagggaaatgttttaaaaactgaacaggaagggattggacctcttagtttttctcaggagaccaggagtatagtctcagtactaagtgaatctgaaaggctctgagctcctggacagtggggtagagtggaggatactaaagcattgggttgagaacagggaaattcagtggaagtctgcatactgcgtggtcagccccttccccacaccttgctcccaaatatagcagcaaatataccttgctttgcagataggagattggagaattcttttcttggaaaatgaatgatcccagagaaaagaattccagatggtaacatgatagggttccgcaatgaaaaagatagctagctgccattcactcaatactgaaatgcatagtggttaaaggcatgggctctagagttaggcttcctgagtttgaactcagacttaactacttaccagctatatgaccttgggcaagttacttaacctatttgttcctcagtattcccatctttaggatggggaaaattatgtttacctcaagattgttgtaaaggttaaatgagttaacaaagcactgctgatggtaagctctggtaaatactagctgaggaaggaggaagtacccagggacttccttagctgtcaaaggcagctctcgactttagatcatgccccaatggtgaccagcagccttttctacataggtggtacatggggtctgaacaggggctttgaccccacagaagacacctttccccagttcctctctctcattcttaactctgtcttttaggaacattctttttttttttttttttttttaccttttttttttattttttattttttattgatcattcttgggtgtttctcgcagagggggatttggcagggtcataggacaatagtggagggaaggtcagcagataagcaagtgaacaaaggtctctggttttcctaggcagaggaccctgtggccttcctcagtgtttgtgtccctgggtacttgagattagggagtggtgatgattgttaacgagcatgctgccttcaagcatctgtttaacaaagcacatcttgcaccgcccttaatccattcaactctgagtggacacagcacatgtttcagagagcacagggttgggggtaaggtcaccgatgagcaggatcccaaggcagaagaatttttcttagtacggaacaaaatgaaaagtctcccatgtctacttctttctacacagacacggcaaccatccgatttctcaatcttttccccacctttcctccctttctattccacaaaaccgccattgtcatcccggcccgttctcaatgagctgttgggtacacctcccagagggggtggtggccgggcagaggggctcctcacatcccagtaggggcggccgggcagaggcgcccctcacctcccggacggggcggctggccgggcggggggctgacccgcccacctccctcccggacggggtggctggccaggcagaggggctcctcacttcccagtaggggcggctgggcagaggcacccctcacctcccggacggggcggctggccgggtggggggctgaccccccccacctccctcctggacggggcggctggccgggcggggggctgaccccccccacctccctcccggacggggcggctggccgggcagaggggctcctcacttcccagtaggggcggccgggcagaggcgcccctcacctcccggaccgggcggatggctgggcggggggctgacccccccacctccctcccggacggggcggatggctgagcggggggctgacccccccacctccctcctggacggggcgactggcctggcctgggctgacccccacctccctcccggatggggtggctgccgggcggagacgctcctcacttcccagacggggtggctgctgggcggaggggctcctcacttctcagatggggcagttgccgggcggagggtctcctcacttctcagatggggcggccgggcagagacgctcctcacctcccagacggggtcgcggccgggcagaggcgctcctcacatcccagacggggcggcggggcagaggtgctccccacatctcagacgatgggcggccgggcagagacgctcctcacttcctagatgggatggcggccgggaagaggcgctcctcacttcctagatgggatggcggccgggcagagacgctcctcactttccagactgggcagccaggcagagcggctcctcacgtcccagacgatgggcggccgggcagagacactcctcacttcccagacggggtggcggccgggcagaggctgcaatctcggcactttgggaggccaaggcaggcggctgggaggtggaggttgtagcgagccgcgatcacgccactgcactccagcctgggcaccattgagcactgagtgaaccagactccgtctgcaaacccggcacctcgggaggccgaggctggcagatcactcgcggttaggagctggagaccagcccggccaacacagcgaaaccccgtctccacgaaaaaagtatgaaaaccagtcaggtgtggcagcgcgcgcctgcaatcgcaggcactcggcaggctgaggcaggagaatcaggcagggaggttgcagtgagccgagatggcagcagtacagtccagcttcggctcggcattagagggagaccgtggaaagagagggagagggggaccgtggggagagggagagggagagggagagggagagagcaggaacattcttaagactgtctccaactgcagcattgaactcttactgttcattttttcaataaatgtttattaggtgcctactctgtgcaagtactgctcaagctgctggaatgacagcagtgaaccaggtctgtcataatagctaacatttactgaatgcttactgtgtgctttacatgtattaagttgttgaattctcgaaacaaccctctgaaacagatgatgttatgatctctgttttacagataaggaaactgaggcacagagattaaatagcttgccaaggccacacagctagcaagcagcagagataggaatcaaatccagacagtcttgctcttgagtctgtttaaaaaaaactgtagagacaggggtcttgctgtgttacccaggctggactggaacttgagtctgtttttaaccattatgcctccctgttctcatggagcttatgttctggaagtgggagactgacagtaaataagtaaacaaagaaaatagagaccaagtagcaataggtggtaccaattgagtatcccttatcagaaatgcttaggaccggaagtgtttcggatttcggaatttttggattttggaatattagcatatatgtaatgagatatcttggggatgggactcaggtttaaacatgacattcatttatgtttcatctataacttgtacacatagcctgaagttaattttattaatattttaaataattttgtgcatgaaacaaagtttgtgtacaatataccattagaaagcaaaggtgtcactatctcagccacccatgtggacaatctgtgatcgacctaaccattgttcctgactctgaatttatatgctactggtaagcaatcattttcttgcacttattcacataactgtaaattttaatcaattaaaaaacatgacataccattaatacagtgaaaaaacaaggtgttcagggtagcaagcagtacagtagcatcaccagagttccttttttagctgttaaaccacagcaacaaacaacagcaagttttcagtctctacttatgatactgtgttttgattaaaagattactatatactatattttatgtttttaggtgaaaagaaacattagaagtaggtcctgtagggatgaggaggcattctgctgtatggctttttaaaatgtcttttctaggccaggcgtgatggctcatgtctgtagtcccagcactttgggaggccgaggcaggaggattgcttgagctcacgaggttgagaccagcctgggcaacatagcaagacctcgtctctcctaaacatttaaaaaaaaattagctgggcgtggtggcacacacctgtagtcccagctacttgggatgctgaggtgggaggattgattgagcccagaaatttgaggctgcagtgagctatgttaacaccactgtactctagcctgggtgatagagcaagaccctgtatcgaaaaaaaaccctgaagtttcctctacagtcttctgcctcattaacaatggttttttcttagaagtctctctttgatattttggacagatatgatgtcttgttctgttatgaatgcacgcaggtacattgcagctgaagggagctgggagggcctttttttcccccttagggatgctgaataaactgttgtgtgcctgcattttgattgcaacccatcacatgaggtcggggtggaatttctcaactcgtggcatcatgttagcactctaaaagtttcagattttggagcatttgaggttttagattttcaaattaggaatgctcaacctgtctgataacatataaaacaagggattgtgatacagagggactggcagagggtagcattagttggggtggtcaatgtttatgagcaccaagtgagataagttatagttttttttttttttttaaacagccttactctgttgcacaggctggagtgtagtggtgtgatctagtgtcagcccccagagtagctgggactgcaggtgtgcaccaccacacctggcttttttttgtgtgtgtgtcttttgtaaagatggcattttaccatgttgcccaggctggtcttgaactactgggcttgagcaatccccctgcgttggcctcccaaatgcgggattacaggcatgagccaccacgcttggctgagttctttaagaattaattacttagagtattgctgtctctgcagatttgcaaaatgccctttctatgatttgatttataatgctactcccacacgttttaatattactaataaaaagcaggaatagttcatgtgcactggtgtcttactgtgtatgagggactatactaagcaatttatatagattgtttcattttatgctcatagcaatgctataacaattcttttctttttcagtcatggaaaactaaagcttaaggagacaagtgacaggcccagggctttaaatttagcaagtggcagagccaggatttgaacagaggtagcctgattccagaaccactgctgttaaatacttaactattttattgatgaagtgatatgtgcaaggtaattctttttataaaaaatagctgacttttatagagatttaaaatattgtaagcattactgggtcttcacagtaacagtgaagcttacctatattttggaggcttcaagacaggacataaacaatacattttgagtaaagaagcttctagggttgtatgattttatcaccccaaattagcaattttgttcatatgaactaagatgcgtaagattctttagcacaaagccagagccaggatttgacaccaggccagttgacttaagatgtagagctgttacccattccactgcagagtaaatgataacatgtagcttatctttgttcaaggtactgtgggaagccaatctagtgaaattacattttaacagtccccaaggaatgtttgttaaataatttttagttttttaaaacttctaaatttctcaaaacaaaagctgagtgaagacagttttattttacagacttggagacagtatggagcagtggcccagagtgagagttcttgggtcagattgtctggtggcttacgctaattttcacttcttgatttaactgattcaagtattaatataattttgaacaggcaaccttgccctccaagtcttagttcccttaattgtgaaagaagctaatatagtatcttcctcataggataagtatgaggactaaatgagacaacctctctacaaagtgcaaggcatggtgccttttggccagccatctcttctcttggaaatggacccctcattcatcattcatgaatccaaagtgaagttttggctccattgccttggttttatcagtgcctgaagtattcttctgacaaatagtgtgcatgaacttagagtatagactttcctgacatatttttgttgctcactttcaagttttaaaaacttacagtaaaatacacataccataaaatttaccatttaaaccatgtttaactataccagttctatggcattaagtatagccatactgttgtgcaaccatcactaccatccacctccagaactttcttcatcttcccaaactgaaactctatacccattaaacaacactagtggcagtttttgcttattattcttagctttgtgaccaaggctgctagttaggagaaatgttactctgtttgtacaaagaaagactttgaaagaaatgtgattagaaatctatattatcccaaaagcataatccataaatgaaaaaatggatatactggacttaattaaaatgaaagcttttgctctgtgaaagaaagtgaaaagacaagccataaactaggagaagatattttaaatcaaatttttgtttaagagatgcagtctgtgttctccaggctggacttgaactcctggcctcaagccatcctcttaccacagcctcctgaatagctgggactacaagtatgtgccactgtgcccagctgcaaatcacatttttgacaaagacttgtatccataataaacttttaaaagcctccaaatttaacaatgaggaaacaaccaaataacaaaatgggtaaaagatgtgaataggcacttcacctagaagatatgaaaatagcaaataaaggaaatgcagattaggcagatgaaaattaaaaccaaaataacaattataacaaatgtaccactctggtatgtgatgttgctaacgagggaggttgtatgtatatggtggtaggaggtatttgtgaaatctctgtactttctgcccaattttgttgtgatcctaaacatcatctataaataaaattaaagtgagataccactgtacacttaaagcggaaataccagttgttggcaagtgtgcagagcaactggaacttttatacgtttctgatgggaatacaaaatgatactgccactttggaaaacagtttgccagcagtttcttatgaaattaaacctgtatctccaatatgactcagcaatcctacttctagatatctctccaagagaaatgaaaacctgtgtttacacaaaaacctgtatatcaatgtttatagtagcattgttcagcattagtcactaaaaattggaaacaacccagttctttcaactggtgaaaaagatgaatagattgttgtatttttataccatggaatatactccttgattcgtgcaataacagattaatcttaaaatgcattttgctaggtgaaagacaccagatacaaaaggctatgtatcatttcatttatccacttatatgaataatcattccatttatataaaaatctgaaaaagcaaaactatagggaggaaaacagtggatgccagggtttgggggtatagggaagtattggttataaaataaaggcatggcatgagggattttggaggtgatgggatggttctctctctctctctctctctcacacacacacacacacacacacatacacacacacacacaccccactacccctctctctctcgccaattgtcaccaaattgatgggcatgttgtcagtgttaatatttggtctggtgtactaattaccacccctcccaaaatctatattatcagcttggtagcatatatagtacaatttcattaaagaaaataaatgatgatttattaactaatatgtcacatgaaaagtcatagaatgtgtattttagtttaaaaatatgggtatggatatacacacacacatttatttatcgtaagcgtcttactttactggaatttgctggttataccagataaactttttccactgcttgagctttcagtagaccattgtgcaagttaatgataaatttcgtgagcataacacctacttaagtttctcagaatctgttacagaaaagcatttatcttgcggttcaggcagcctgggatggaaggtaaatgctttctttttataagtatcctgaaatttcaagtgtaatagggaacaagatattaacataaattttcaaaaggcctcattcagttctagttccttttttttctttacaaacttaaatctcttcataaccatcagatgccataccacccttgtgaaacagtctgctagaactagacatgtctcaggattcttagaggactggggtaaccaaagtgggatttgaacttgtttgaggaatatacatgggtagtgagctgaaccttttaattcctagaatttatgggtttaacactacaagggttgtcaccctgtttatttctgtaaataattaaggcatgtttattgtagaaaacttcacaatgcacagcacagattataagagtactaccaggattattactcctaagataactgtttatttagttttccaaactttgctacgtaggtatatacatgtgtgtctgtccatgtctccttttaaaaacaacaaaaaaacctcattttaatattcaatatattattgactgtctttgtatgtgagaaaatttaaatataatagttgtgtattctactgaatatatggaatattatttattttaccaattcccattttattagtcttttaacttatatccacttattttggctgggcgtggtggctcacacctgtaatcctagcactttgggaggccgaggcaagtggacaacttcagtccaggagttcgagatcagcctggccaacatggcaaaaccctgtctctactaaaaatacaaagaattagctgggtgtggtggtgtgtgcttgtaatcccagctactcaggaggctgaggcacgagaattacttgaacttgggaggcggaagttgcagtgaactgagattgcaccactgcactccagcctgggtgacagagcaagacactgtctcaaaaaaaaaaaaagtacatatatccacttatttttgctctgatgaatattcctatattagtatctttgagtatctttccattatccctccatttatttccttaggatatattcctgaaagcagtatggccgggtcagagagtggcactttttaaaaacttattttttattatcaaagtagtatatatgctcatagtaatgagaagacacaaggtgcaaaaaggtacaaggtaaacagaaaatgctctgacttaacagttcccctctcagaggaactgtaaaataaacagatatacatttacattaatttatacattctatagaaaattcatgtgtgttagatgatatatttgttttcttgaaacatccactctaattacagagtttactaaggttacagagttaatatagagaggtattagagagtttaataaggttggcagttaaatatatcaaaattatgcagttatacaattatatcacatatacaccaacaataatcatctagacaatataatgaaaaaagctcttattcgtatatatcttcttattaagtttattccttagtatttttttttgttttttgggggggaccccccaaaaacaaaaaaatactaaggaataaatttaagaaatgtgcagtaagattcaatattgtaaaaagaggttaactctatttaagttagtctataaatttaagagattttgatggagggaggatctgacacaatgatgttaaggttcatatgaaagagtaaatatttgaaaacacacagagaaattctgaaaaagaaggatgacaagggggatgtgccttattagacaaaaaaatgcattaaaatgtacaacaattttaaaaagtaacattgtacctaatatattgtacacttaaatatgtgttaagagggtaactctcatggtaagtgtttttactccaataaataaaattttaaagaatttcttcatcccccctccaaaagtactggcaccaaaatagaataacaaatcaatgcaagaaaacatccagaaagagacccccaaataaaaatttagtatactgtatatttaatagtggtagcttttcaggtagatgaggaaagagtggcttacttaacaaatggcattgggacaatcagttaatgattttgaagaaaaaaagttagtttcttatgttatatacttaaactaaaataaattctagatgagttaaggatgtaaatgtaaagtacaaaaggtactagaagagagtgtaagttgaggtaaggaaggccttccaaagcctgacaccaaaggcatggtacttaaaaattaaaaaaccccacaaacagataaaagataaacaagaaacttaaaaaagactaacaatatgtgacaggtaaatgatgaatatctttaatatgcaaagatctcttacctatctgtaacaaaaaaggtaaacacccaaaataaaaatgcacaatggaagtaaacaggcagttcacaaatgaagaatacaaatggtcaaaaaatctcacaaagttattggagataaaaaacagatgatcatttttcacataacagattgacaaagcttaaaaagaattttcatagtacctgataaaagtgtggctagacactttcctatactgctagtgtaagtgtgaaatgatatctttccagagggtaatttacagtatgtatcacaagccttaagaagtactatttatatttagaacatgtggaaaaataaaaaataaataagtactatttatatatgttgttagtgggtatataaattgatacagtttttctggagggcagtttggaactatttatcaaagtttagaatgtacatgccctttgtcctagcaataacacttccaggaattttatctaaaagatatgctcatgaagatgtatatacaaggatattcattgaagcagggtttataatagcacaaaactgaaaacaacctaaatgttaatcaaaaaggaactaattaaataaaatatagcatatccacataagggaatattacaaccattttataaaatggtacgtttatctatcttctttggggatagttcagttttgttttttattgtggaggtctatatgtccttaaaatttttttttctttttaataattagagatgaggtctcactatgttgcccaggctggtcttgaactcctggcctcaagtgatccttggcttctcaaagtgctgcgattacaggcatgagtcactgcacctggcaggaggtttatatgtcttgatacaaggtgtaaaagatatgttaaatggaaaatgcaaggtgcaaaatagtacatatagtatgatcccatgtgtgtaaagaagaaaaaatagggaagatgggcattacagaggctttaaaatgcactgggaataataaagttttcatttttatctttagagtatagttcatgagtgaattcttttccattttttttcccagttatcttaaaagctctgttgattgtggatctgagaactaacatcacatgttataaaatccaaatagaaaatatatttaaattattagacaatttaaagcttatgagaacataagaataaaattactgcattcctttgcttattaattaagtatatcacactaacagaatttatttctgtgggaacaatgttaactcataggacccagatggaaatgatatgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgaaatgtgattccccagtgttggaggtgggacttgtgggaggcgattggatcataggggaagatccttcatgacgggtttggcaccatctccttggtgataagcaagatatggtggggggttttttttgtttgtttttgtttgtttgttagtttgtttttcaccatctcttacaggaaggagaaatctggttgtttaaaagattctggtacctccccctgtctctcttgctcattctcttgccatgtgacatgctggcataccttcgctttctgccataattgtaagcttcctgaggccctcacaagaagcaaatgccagcatcatgcttctgtatagcctgtacaaccatgagcccaaataaattctcttttctttataaattgcccagtctcaggtatttccttatagtgatgcaaaaatggactaacagtgttcttagcacctttttttgaaaatcagatggctgtaggtgcatgaatttattttagggctctattctgttccattgtgtatgtgcctgtttttataccaatactatgctgctttgattactatagccttgtagtatattttcaagtcaggtagtgtgatgcctccagccttgttctttttgcttcagattgctttggctatctggggacttttgtcattccatatgaattttagggtagttttttcctatgtgaagactgtcattgatatttttatagggattgcattaagtctatagattgctttgggtagtatggccattttaacaatattaattcttccaatccatgaacatgggatagcttttcatttgtttatgtcttcttcaatttctttcatcaatgttttatagttttttttttttttttttttggagacagagtctcactctgtcacccaggctggaatgcaatggcatgatctcagctcactgcaacctctgcctccagggttcaagtgattctcctgcctcagcctcccaagtagctaggattacaggtgtgcaccatcacactcagctaattttgtatttttagtagcgatagggtttctccatgttggccaggctggtctcgaactcctgacctcgggtgatctgctcccctcagcctcccaaggtgctgggattacaggtgtgagccaacgcacccagccagtgctttatagcttttagtgtagagatctttcacctccttggttaagtttattcctaagtatcttttttttatgtagcaattgtaaatggaatttttttttcaggtggtttgctattagcatatagaaacactactgattttaataagttgattttgtatcctgtgacttactgaatttattttttagttctgttttttagtagattctttagggttttctgtatataagatcatgccacctgcaaacagggacaatctgactttcttctgaaacttttttttctaaactatgttaatgggatttatccctgttgctacttgcagctctacttcaagctttctcattctcagtgctatagacatttggggccagatcattctttgttgtgaggggctttcttgtccattacaggataattggcagtatccatggcctctatgcactagatgccagtagtactcccttgctgcactctgagttgtgacaaccaaaagtgtctccagacattttgaaatgtcctattggtggtgacatcaccccttctctcagtgagaatcacatttctagttcattcattttaacttctatattatgtttcattataaatataccacaaccaattttttcatttccttgttgatggacatctagattatttccaaagttttaactattagcaacattgttgcaatgagcatttttgttcttgtttccttgtgcacatgtgtgagactctgtctaaggtactatgcttaggagagaaaatgttgagttttaatatatgcatattttcaactctaccggctatcatgaagcagtttccataattgtactaatttatactctaaccaacggaacaagagagatcctgtttctccatatcctcaccgacacttggtattgtcagattttgagatttttatctacctgatggaggtacattatattccttgattaccacaaggatcacaaattgtgcagatagagttgtatccaaaaaaggattaaggctgggcgtggtggctcatgcctgtaatcccagcactttgggaggttgaggcgggtggaccacttgaggtcaggagttcgagatcagcctggccaacatggtgaaaccccatatctactaaaaatacaaaaattacctggggcctggtggcatgtgcttttagtcccagctactcaggaggctgaggcaggagaatcacttgaacctgggaggtggaggttgcagtgagctgagactgctccactgcactcccgcctgagcgacagagcaagattctgtctcaagaaacaaaaacaaaagcaacagcaaaacaaaacaaaacaaaaccccaaaaaagaattaaatcttactgcatgattattgagaatacaggagcctttcccaaattataagtgctgattattttaggggaattttagaatgatgtttgagcttctgtgaccagctttaagaagtggttttgaacaatcagacttcatatgtgccatgttttctactcaatttctgtagtttctatttccaaaccagagatgatcatctagtcataatattgttcttcatcttagaaaatgatattactgatggtgattaccatctctacttagggaatggctcaaaatatattaataacttgaagttatttccctcagtgttgttggatgcttttgttctcagagtcactcatcactaacagctggatgccaaatttgtctctttgatactgtcgtttcccagaagcctacatgttttttccatactatatgaaactgtttatgatcttactctgttttctgagtcattttgctaaatgcagtaggatgttacaaaagatattcctggttttgtacctacctttaagatttaaaatgaaaacgatggacataacatatataacaaagtcaattagagttgtgtgtatatgtaataaagtagtgagagtgagatggaattcctccaaggtttcatgtgtaaagtccaatttaagtagagttttgaaaaaaaaacaatgcaggtgaattacgaaagcgaaagaaatatgtattcagaattgatatgacttaaattaagatgtagtgggaaaagtggcttaattagtataatttttgtttgtgctcacacattgtggactcctcaatacttacttcctgggtgaattatccagtgcctttctgcctgactgatctctctcagttcctcagtaagcctgagagttagtccagtgctttggtctgggacataccccatgataaaactgtatttcagtcttacattcctaaacaggtaaactagccttcacctaccaaaggtattgtattctaaaagtttgttgccaattctgtttgttgaatttgatgttttcccataaaacgatttagtcaactttggtaatcttgcaagatcagccctcaaaagccccatttgacccataagatacaggagcaagtctgagttctgtgttctggaggtagacagccaaagctataagaagaataaggaagagtttccttttttaggctcaggactatccttagataaaattttgataggatctgtttgttttagacattcttctacttccatttttatacccttgtactgcttcccactgactcctcctgggctcctaataccttcatgcttgccttaagtactccatcctggactcgccacctgaactcatcctatttgtcctttgctcccaaacttgcctttcctgtcctatctgggcttttgttctcttgtagtaactgaccttatgtaggtattaagagatataattccaactatcacccccctgattatcaaaaaagagtttatattttaaaaagaagatacactggatgttaagacaactgaccttcaaaaagtcacttcatgggggaaaagagatatggaaggagctattctagattaaatgagacaaaagagacataaaaccaaatgcaatgtgtgaaccttgtgagggtcctgaatagtaaaattggacttcttcagacttgaaaacttgtacacaaaaggacactatcaagagaatggaggatttgggtacaagcggttgaaagatggtttggctgctctggtcggattctgccgtcccagtgaggctggaaaatagggtctagaggcaggaacataaggctgattcacacttcagctatgacaggaaatatcctctcatagagcataggccaagtaaatgattttgtaactttacttcatcctctccttttacatagggtgtactccaagtagagggtatttaaactcaaaaaaactctgtaagagggccttttgagcccctgtgctcaggcctgctcccatactgtggagtgtactttcattttcaacaaatccctccattccttccttgctttgtttgtgcgttttgtccaattctttgtttaagacgccaagaacctggacaccctccactgttaacaccagcccttccctgtggctgaccctgaggtgttatgagtttcttcacagccctacttcctctctcttctccctcattttcagacccttcttcagcatcttccctgggcattgctgtgagtttaggccggcccgttttgagcaggagcagcagcggaacagtagacctgctggaggaagtggggctgcagatcagagacacagcattttcgtcaaccaaacttcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtagattgcaaaatgttttctcccattctgtaggttaaaaggctgaattttatagcatgtgaattatatcccaatttaaaaaagaatgcatatgtcttagttcaggcttccataacataataccatagactgggtgggctaattgttcaaagctccacagaaattagttggagaagttacaagagtccattaatcatcttgctttgttagtagcagcgggcatggttcagcattttctgcttaagtttctctgagctcaccaaaactaaaatgatgttgtaatactttttttttttaattgcacatcactcctttattatactgatctggtaaaaggatttagtacagttatgctcagatgaacactgggcccatgtggcagggtcaagcaactagaacatgattcagaaatcagtgaaagacacacttggacaggaccaagaggcatttcactgccatgaaacaaggcaggaagggattctaatacacacaccaggaagcactcctgcccctcagaggtcaaggagctgatcctatattggtatgaggaatggcttattttctgatgaccacatgtgggactatttcaaccgccacaagaaaccccagaagggttattgttttgtattattaatatatactatacttttttaataaaagtaaatataacacataacgaaattcaggattgatcccaacctagagccagatcctctggggtcaaggaggaaacagttgtcacatcaccatgcagattacattcatcttccactggaatgactagagcccccaggcagtggcctgactgcagaagagcagaggacagactctgctcatggggacagacaggctctgttgcttctcctcattggtcgtggcttagcatgttcctccccaaagtccttagtaaacaaagcactcacaaaaacccaagtcactacttttaaactctgttggataaggggagcttttccacagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagaccagcagggagggtgctcctggggacagtatcctccccgctggccttcacttcttggccttgccctgggcagccacagcttctatggctttgcacaccgtctcttcatcccccagaaactgcatgggcttgataggcttcaagttcttgtccaattcatagacgatgggaataccagtcggcaggttcagctccatgatagcctcttcagagagaccctccacatgcttggcaatgccctggaggctgttgccatgggctgcaatcagtacacgtttcccctccttgatctggggaactatttcttcattccagaagggcagagctctggcaatagtatccttcggactctcataggagggtagctgatcttctgtgaggtctgcatacctgcgatccttactgatgttgctgtagaaaggatggtcgggctccatcggaggtggtgggacatcataggagcgcctccagatcttcacctgggcctcaccatgctttgcagcagtttctgctttattgagaccggttagacccccatagtgccgctcattgaggcgccaagtcctcaccactggcagccacatctgatcaatggcatctagcactgtccagagggtccggatcactctcttctgcactgaggtgaggcagatgtcaaactcatagccagcatctcgtagcgcctgcccgccgcgcttcgcctcctcgtggcccgccgggctcagatcggcgtcgtaccagcagctgaagcggttctccaggttccatgtgctctcgccgtgccggatcagcaccagtttgtaggcggccatggcggtgggctgcaatactttttataccatttgaagtaaaaggtacaaaaggttatacgctgaaaattctttttcccacccttattccctaaccactcatttcccctcaccagaggaaccactgtttccatgggatatattagattgatttatatgaaattgccggtgtttgactatgatgatttcatgtggttcagcctaatatcagtgaaaaaacagagtcctatcttcatggagtttttattctagtgggaagtgtattacttaattattgcagtgtaacaaataaccccaaaatttagtggcttaaagcaacaaacatttattatctcacatttcctatgactcaataatttgggagcagcttagatgggtagttctggctcagggtgtctcatgaagttgtagtcaatatggtgtctggggatgtagtagtttaaaggcttaacttaggtctgaaggagcagtttccaaggtggttcacttacctggctattggcgggaggccttaggtctttgctggtttttgacatgaggcctcagttcctcaccatatgaacctctccataaggctgcttgtatgtcttcatacttggtaggtggcttcccccagattgcgtgattcaggagagaggacaacaaggaaaacacaatgcttttttctcctcttgcaatgttttttatgacctagtcttggaagtcacaccttgtcgcttctaccgtagtctattcattagaaacaagtcattaggccaggtgtggtggctcatgcctgtaatcccagcactttgggagggcgaggcgggtggatcacttgaggtcaggtgttcgagaccagcctagtcaacatggtgaaaccttgtctctacttaaaatacaaaaaattagccgggtgtggtggcatgcgcccgtaatctcaggtactggggaggctgatgcaggagaatcacttcaacccgggaggcggaagttgcagtgaactgagatcgtgccacagcactccagcctgcgagacagaattgagtctcaaaaacaaaaacaaaaacaaaaaccaaaacaacaacaacaacaaaaaacaagaaacaagtcattaagttcaggccacaccgaaggggaaaggattaaattccacctcttgaaggaaggagtagcaaagaatttgtgggcgtattttaaaaccaccacaggaaggcagacaataagcaataaacagaataaatcagcaagttatggagtatgttagaaggtggtacgttctatgaaaacaaaagaaaaagcagaggtaaggggaatcagagtatgtttgtgtggaagggatgtaggttgcagttttaaatagggtggtcagcatagtcctcattaaggttagatttgaacaaagacttggagacaaagaagttagccaagcagttatctggaagaagaaagtcccaaagcaagagaatagctaaaataaggccttgaagtaggagtcatccttgcatgcgtaacagccaggaggccagtatgactggcacagagaagggtttggtgagtggtagaagaggaggccaggtaaacttgagggggacaggcatgggaaatcatgtgggaccttgttggctgttgtaaggatttgaggcatttttgattagttcttaattcgtacttacaaatgttaaatgagattatgtatgggaaacattagtaatcaggaaagcactctatgaaagctagttacttgtattaaagtattgaaatttttatttttagttagcatatccatagaaacaactttcctttacttcatctaaggtgataagaattttttttctaagcaggaagaatgcttaccatattttattactagcacattttaattttttaaacatgacacttgagcatatataaaatgtagcatatttttaattggggaggtgggggaaaagttgaggaaagattatttgcatggctgaaattaatgaatttattgtttctaacaggaatgtaatgaggaaatcaaaatggatccaagtatgggtgtgaattctgttaccatttctgttgagggtatgacttgcaattcctgtgtttggaccattgagcagcagattggaaaagtgaatggtgtgcatcacattaaggtaagttactctttggaaactgaagtcaaatgccattgaagagaattctactagaaattacttctaacaatgagatagaagcagacacactgacacatttggcaataaaaactattgtacttcttatcttgaagctaaataagttttctttgacccattaattcctctcataaagaaaaaagatatattttcaatttaaaaacatctgaacatggaatcttgatattgtggttgtatatttatagatttatattttataagtatatgagtatttatatactgtttattactctgaatctcatactgaactaaaatgtatgttttcaggggatgggttagggttttctttttcttttataacatggtgattattttgcaattaaaacttgaagggaaaatgtctagagaattactagtatactttggtttttatttttagtttttttttcagacagggtcttgctctgtcacccaggctgcattgcagtggcaaaatcacagctcactgcagcctagatttcccaggctcaagcaatcctcccatctcggcctcccaagtacctaggaccacaggcgtgcaccaccatgctagctaattttttttttttaagatggagttttgctcttgctgcccaggctggagtgcagtggcacgatctcagctcaccacaacctccacctcccggttcaagcaattctcctgcctcagccttccgagtagctgggattacaggcatgcgccatcactcccagctaattttgtatttttagtagagacagggtttctccatgttggtcaggctggtcttgaactcctgacctcaggtgatctgcccacctcagccttccaaactgttgggattacaggcatgagccactgtgcccggctgcatgccagctaattttttaatttattttttgtagcgatgggggtctcactatgttgtccaggctgatctcaaactcctggactcaagtgatcctcccacctgggcctcccagagtgcggggattacaggtgtgagccaccatgcccagccaaaattactagtacaccttgtatgatatgcctaaggaagactctattattggttttttgtttgtttgtttttcagactctagggctttaagttgaagactctattgttgtttaacattacttgagcatcaacagcattctagatatactgtggttaaagatgtagttcaggttataaaaaagccttctgaatactgcatgaagtacctgtggttatcataagaaacttcatgcatatatggcagggattggaaaatggtgatctgcaggccaaacccagtttgccaactgctttcatatggctcataagctaagaatgccttttacatttttacaccattgaaaaaaattaaaaaaatatttaggaacttatgaaaagcacatgaaattcaaatttttgtgtctgtaagtaaagttttagtaatatacagttttattagaacacagccacactcattcatttacgtattgtgtacagcccttttttcactacaagagagttgaatagttgtgacagagcccatacgtggtgtcctcattggtaagtgatacactgccaaatgatttaccacagtggaaataccattttatcttcccaccagcagtgtttgtgttccactttgaaagtgttccattttctccacattccctccaacaatttgtattgtcagtcttttaaattatagacattctaatgggtgtgtaatattacatcactaattctcatttccttaatggctaatgatattgagcatcttttcatgtgtttattaggcatttgtataccttctttggtgaaatgtgtgttaaaccctttggccaaatttttagttgggttttttgttttgttgttattgaatttcttctttttcaaaattgttttggttagtctaggcccttttactttccatataaattttagaatcagtttataagtttctacaaaaatatctgctgggattttcgttgagattgtgttgattctacagatccatttggacagaagtaacatcttaccaatattgagttttccaatccatgcacatagtatatgtctatttatgttggtattctttgatttcttttatcaggaatcaatagttttcagcatgcagtttctgtacatattttgttagatttatatttaagtactttatgtttttgaatgctgttataaatggtactgtttttaaattttaaatttaagtttaatttcaggtgttcattatgaggtttttatatgttgactttgtatcctggaacgtagccaaactgacttatcaaacctattagcttttttgtacatttcttgggattttctatgtaattatgtcatcaaggtatatagtttttttttttttttaagatagtctcactctgtgacccaggctggagtacagtggcacaatgttggctcactgcaacgtccacctcctgggttcaagcaattctcatgcctcagtcacccaagtagctgggattacaggcacatgccaccacacctggctaatttttgtatttttagtagagttggggtttcgccgtgttggccagggtggtcttgaactccagaccttgagtgatccgtccacctcggcctcttaaagtgctgggattgcaggtgtgagccactgcacctggccacatagttttatttattcctttgtagtctgtatatcttttttttttcccttgtattatcaaaccttcattacaattttgattgggagtggtgagagtgaacgatggttgggggaaacattcagtcatttacagttagcattgtgttagttgtagagttttgtaaatactatttatcagattaattaagttatttctattactagtttgctgagggtttttttaaacatcatgaatggatgttgaattttgtcaagtgctttttctgcatatagagatgatcatatggtttttctcctttagtctgttaagatggtgaattacactgattgattttcaaatgttgagccagccatgcattcccagggtaagcctcacttggtccaagaagacttactttccattaaaaatttcaaacatacacaaaggtggagaaactatttttttttattatactttaagttttagggtacatgtgcacattgtgcaggttagttacatatgtatacatgtgccgtgctggtgcgctgcacccactaactcgtcatctagcaactattaatagtacaagaatctaccctatacccatcacctagaaaaatccttgctatttatttgcatgccattctcatcagttgaattttataatgtgttttgctgatgattctaagagttggtccaggccttcctgcctattgtattctgttaaggtagatgtctctgactagtggattggaacttcctagtatatctccataccagttgccatttctaagccttttggccaccccctgccaccacccctgcccgcccctttcccttgtcactcttcgcaattctcagcactaattgtagtgtatataatttcagtactctttcccatgctttatttagtttgtttttgaacatatttttttctcatttctctccaacttgtatctcaggatccaaagaattaacaatatctcatgccaaaagcttgaggattcctactgtattgacaataacatacagaagctttgcttaaatattatgcttactttttttttttttttttttttttttttagatggaatctcactctgtcgcccaggctggagtgcagtggtgccatctcagctcactgcaacctctggctcctgggttcaagcaattatcatgactcagcctcccaagtagctgggactacaggtgcacgtcaccattcctgggtaattttttgtacttttagtagaaacggggtttcaccatgttggccaggctggcctggaactcctgacctcaggtgatccgcccgcctcggcctcccacagtattgggattacaggcatgagccaccacgcccagcctgaattgcttacccttaaacatgtttatttttactgccaggccttaatgagtcagtaatggatatgtcattttagctgagttgtattctcatttgtgtaatatacttatcattttaatgttatcttatcattaaaacaaccttatattggtggtaattctatttgctggaggttctctgtaattttgcttttatgcaatgttcattacagtaatggcgggaagttaatgccactttggaatttgatcagcttgcatcactaccagaatggttttcctatgactagttgagatccacatgcaatacattttttgacatactaccaggagcagatgttaatatcataatgaaagctttgtccaactggacatcagatttagcacaaaattcaaaattagggacaagatggattctttctaattatcagaagctcatcatatttttaagggcgtgaatgattacattggaactagaatattttgtgtctccagatcagatacttgtgagagctctactttttaactattcttgatctaaacattaacttttaccatttatttttcagaggtttcaaaatggttttggctctttagtgaaatacagaatttatactttatctctgcagtattcttacctaaaattctgatttattataagatcttgagtagattggtttcagtttgccttgtttttattacccaaaattggctaattagcccatcattactctctatgaagtctgatacatttccttaattcaagagtcctatgaagtgtggtgctaatatgtggacaattcttctcttcctaatctgaaactgtaggtgattttttccatgtctaagttttatagtcatcttggccagagagtaaactttggatccatattactatttgtatgagggaaaaagcagtatttcttgtttgttgactctacactctgattagctaagactatgttgatagctgtggctagaaaagttttatttacatagcatatattccttctcctaagttttctgtactgttgacatccatgtgactacttagatatgaactttccattttcacatgctccaaaggtagattttttttttcttgtattcaccatctaccttggcgtaattccagtcttagaggctcccacattgcttcttcccggcaacatccccgaacagggatacggttgcctttaatgatctttggggaaagagccaagttggaaaagctgagagatgacaggtaattattttacgtatttatcttcaaaatattcaaatttatataaaaatattttcccctaatcatatctatgcaaaagttaggcatattttgcagtttgttgattagtaaagagaatagtaaaagtagctctgcaaactcaatgctaatgctttaaaaatgagttgcttaatttcactgagtaataagtatgacacatgaatttgatttatcctcagatgaaactaattaaacctcctccacttgatctgaggtggggctggtgttgagggccagaacagaagctgaaccttactaattatatagtagtgtctgtgctaattgcagtaaagctgttttaaccatttggaaactagttcatgtaattttttgccaaatgacttaggtacttattgtccactgacagctaaagtattttccaaaaccctcaactctctgtctagcaaactattgtaggtgaatatttgtctctgccaacatatccatgtataactataaaactagattctgctttgatgtttgcaaatacattcttgcttcccaaaacagcctgtttgcatcacactcatatgtaagatggctatttccgctgcatcttcccaaagttcaccactgcttaataaggtctgtttaaggtcaaacaaatgcaattgaattttgattacactgaaaatgaagaatagcagcaatataatgtgaaagcactttgtgttgtcaacagtgatttatacaaattccagtgacagatactcaagactactttccagggcacattcataatttgattgctaaaaataaaagaaaacacacttgttctgcctttttcagctctgcttctcctctttcagtcaaaagcccttatgttagtaacctttattcttttttaaaaaaatattttactaagtgtgaagtgttctggggccagagagagattttctgtgaagttaatgaagcttaagtttcagagctcctcatttgcagtgaccttcttctaagactctggaaggagtatcagcaatgtgtttatatggtcatgtgtttttgtacaatttgaaaaattaaaaaaaaatttaaccacaacccttcaaggccattgtccatttctacttcaatgactcttctgttagacctcccctttgtgttagtgtgatattggaatggccatgagctttttggggatgtgactaaggggaggttgagttggggatatgtttagtttggggttagtaggctatttggctataggtggttctttgtcacttctgtgtatagtggagtttttgctaggaattctgatatagggatggcttcttggaacacccctactactcatggggccaactcactaagcatcatgacatgaagatgcagggctcagtgtaaaactggtaaatgaatgttaccagttcaaagaatatgtaagattagtcacttcacaagtaaatttgaaatgccctgaaatcttacagctcatatatgaaagaaactcaacagttttctcaaatttgacagtagctttaaaaatgtatcaatgcctagttgttatgttgaaaggaacttttctaaactatcattaattttaaaaatttttatctagagaaaagactgaactatttttattttctttatatacaagtgattttataaagtcgtcaaatgaagcactaaagaatatacagccaaaaacataggaaaagaaactatcagagaggtatatcaggcattattaataaaaatgttattgttatggatttttatgatatttgttagctttaaaaatttataacttgtgatttaaatttttttaaattttattttgagacggaatcttgctctgtcatctgtactggaatgcgatggtgcgatctcggctcactgcaaccttcgcctcctgggttcaagtgattctcctgtctcagcctcccgagtagctggcattacaggcacgtggcatcatgcccggctaatttttgtatttttagtagagacagggtttcaccatgttggccaggctagtttcaaactcctgacctcagatgatccgccccccttcaccttccaaagtgctgggattacaggtgtgagccactgcacccggccatataacttatgatttttgttatgcgctcagaatattttcttttgtacaaaattttgtgtttatggttttttattcctttttttaaagaaggcccttcaaattgtttaagtttcagacaccacaaagtgtgaattcacctctttctagacatcatatagaaagctgtctttgcccaaacataatttatagtcagaatgtagttcaacatgatcatacataaatattgattactttttaaagaatgttaaagcttaaaatttctgcaaataattaatgggaactaggcttaatacctgggtgacagaataatctgtacaacaaacccctatgacacaagtttacctatatcacaaacctgcacatatacccctgaacttaaaagaaaagttaaaaaagaaatgtacacaaaaaagaatatttctgaatcataacttctaggattataattaagcctcaggtgcagttaatttagaaatcagatttggggagaagagtgtttcaactaagtcaaggagctcttggtagtgtttggaatgaagtaatataattgtgatattaaattgagtaaagttgttttattggaaaatgcaacagcagaacagattaattaacagaattcaaaaagagtgaatagtcaggaaatctctaattttggaataaatagaatatgactatttgcctttgcaactttagaatttaaatgcattttgggaattgtgtcctaagttatacagtaaataaatgtaattttcttgtttgtactgccagtgttaagactgtagactttaaagggattaacctgaagtttaatttaatcaccctggtggtctgttcaaaggaaaagtaaaataggcagataatgtgaagatctttctccggggttgtttggcctttttgaaagtggaagtataaaaacaaatttaattagatataagtactgaatgattccaaaggttaatgccttattaacaaattagtttgtccctgaaacttacaacactaactttttgagtgcttttcctttttaattagataaaggctatagtccattctcttaatagagactatcctttagaaaaatgaccacctcacggatcacgaggtcaggagttcgagaccagcctgaccaacatggtgaaaccctgtctgtacttgaaatacaaaaattagttgggcgtggtgtcgcgcacctgtaatcccagctactcaagaggccaaggcagaattgcttgaaccctggaggtggaggttgcagtgagccgagttcatgccactgcactccagcctgggcaacagagcgagactccaactcaaaaagtaaataaataaaataaaataaaaatgaccacatcaatgctagcagttactaaattcctcctttggatcaataaatacattccttactccccttacaattaattggtgtttttattattgaaaaagtaacacatacacagagtaaaattcctctcccaaggaaaaccagttgtcctatgtatatgtatccttccagaaagactattaatataaaacttttttttaaattattttttgagatggagtctcgctcttgtcacccaggctggagtgcagtggtgcgatctcggctcactgcaacctccgccacccgggttcaactgattctcctgcctcagcctcctgagtagctgggattacaggtgcctgtcaccatgcctggctaatttttgtacttttagtagagacgagttttgccatgttggccaggctggtctcgaactcctgaactcaggtgatccgcctgcctcggccttccaaagtgctgggcttacaggcatgagccaccgtgcccagccaaagctatttacatgtacataagtatatatacttgatgtgtgtgtgtccactttttctaaaaatggaagcatactatgcacatcattctgcaccttgcttttttttaaattagcaaatatatcttagatattgttccacatcaatatacagagccccatctaatatttttctttctatatgggactctttttttggcttcttagctttttctggcaaatgacagtgcattgaatattctgtttttcaaactggtgctctgtcaccaatactatattagagtaacataggcatttttattattataaattagtaggtaataatcatttatccatgaagatgtcgagtcagcttcaaagaggattaggtttctgatttagctgaactctattctgaggaccaaaggaaggtcaaatccaagataaaaaatttagcagtgaaggaatggtgtaaagagggactttcactatttcttttgtatatttttgtgtttaaatttttatagcgaacaatcatacatttgtcatataatgtttgaagcaaagtgaaaatacattagaaatggccaggcatagtggttcatgctgtaatcccagtactttgggaggccaaggtgggaggattgcttgagaccaggagtttgagaacagcttgggcaacatagcaagaccttgtcttttaaaaagaaagagagaaagagagagagagaatgagaatatattagaaatgagaattctgacaaagtactcagtttaaagatggtttagttcatgaaaaacaatgctacaatgtaataaaaactaacagaatgtctgcatctttttcatcttaaaacatttgatttttgaatttttagattgattttggactattatttagtgtctaaggattgtctttttctagtttataatctgatataatagttttaaagtgataacctttatttaggttactcaaataggataaatgttcatggagcttgatggcttcctcttacaatattttaattttcaatattctatattgaagcatcaaatagagtgttaccctattaatgtaaatacattatatttttcagcaaaccataatggaatttgtattgagactgtatgtattataagtgatgatctttttgtatattataaataatttttagttgattcaaaaatatattatgggtggtgaatcaaacatattagaaattcaggataattgattaatcatgtcacttttctgacttcagtctccacatctgtaaaataacagaatcctttcaagctgtgaaaaatctcttataacctttatgttgagttgttatatgaaaatgtaagaaagtaagctttaaactgtctgaagattcccacactgagcagcatgctaacctgaatttattatgatcatatataaattgattcctgggggataaaaaggaatttcaatgtgctaaaacttgagctaagttattttcccatagtgacttttaaaaatgtggaaatattagaatgttctgattgtcagttctgttaaaaactcaaatgtgttttaaaatcatttcaaatttaaactagcatgggagaatatgtgaaatgtgagaggaaaaaacaaacaattaaaatttggttcaaacactagaaatattgtatacttttcagattatttataagccataaattgctcaaatcataggcatagaattttagttttccaaggaaattgtagattatttagcataatcatttatagatgtaaagagtgtagactttggagttacatacacctgcatttgaatcctagctctttcattttcttgttgggttccttgggcaatttattcaatttcctggccttcatataggaacctggatcacctttgtcttagtctgttcaggcagctataagaaaataccataaagtgggtggcttataaacaacagaaatgtatttctcacaattctggaagctgggaagtccaaaatcaaggtgctggcaaatttgatgtctggtgaggattgacttcctggttcatgtattgcgccttctccctgtgtcctcacatggtggaagggacagggtagctctctgggacctcttttataagggcacaaatcccaatcttgaggactctgtcttcattacctaatcacctctcaaaggccccctgccaatattattaccttgggaattagcatttcagcacatgaatttttgagggacctttccctatcaaataagaaagaatacagaagagaaaacatgtactgatgacaacctaggaagtggtagtaacatagttttttagcttatatagaaagttagaactgaaaagattattttatctagtctctcaggaaactgaagccctcagaggtagggtaatttgtttaaggttctagctttcatattgcctaagaatagaagatgcagtctttgtgggtttatgcaaattatacagaaatcatatgcaaataaagtatactgtgcctgaatttcatgtttgacatttcaagagacacagaacaccacaaaaattaaaagaatcgatctttacaatctctgtgacagtcagcactctacaccaccattaatactatgaaggccacagagtacgtttggtatattttccttttttctctcccactactgccttcatcaaaatacagtgaatagtcctccatcttcagtctttcctatgagctatatttataatttgtaggctgttacatttattttcagaggaacttttttttttttccgagacggagtttcactctcttgtccaggctggagtgcagtggcacgacctccgcctcccgggttcaagcgattcttgtgcctcagcctcttgagtagctgggattacaggcgcccgccaccatgcccagataatttttacatttttagtagagacggggtttcaccatgttggccaggctggtctcgaactcctggccttaagtgatacacccacctcggcctcccaaagtgctgggattacaggcatgagccaccactccggcccagaggaacgattgatataatggaaaaatagttcctctgaaaataaaaataacaacattggttcctaataaaagattaagagaaaaagacaagctgtcgaaatattggagcaatgtggggaatgaggaaggtggggtagggcagagaagggaagttatttttggagcaggggttggggttagaggacatatgaaaggagagcagcacagacccggaatcagactgccgccagcactttccagctctatggagtctgcctggttttgctcatcactgtatctctagcagctagcatagtgccgggcacataatggacattcaataaatatttgttgaatacataagtacctttttttttttttgaggcgaagtcttgttttgccgcccagcctggagtgcagtggtgcaatgtcggctcactgcaacctccacctcccgaggttcttcaagtgattcttcaagtggttcttcaagtggttcttcaagtgattctcctgcctcagcctcccgagtagctgggattacaggcacccaccaccacggccagctaatttttgtatttttggtagagacgggttttcctgcattggctaggctggcctcaaactgtgacctcaagtgatccgcacacctcagcctcccaaagtgctgggattacaggtgtgagccaccacgcccagccaataagtaccattttgacttcctgcccaaagatttagcacccagagctgtactgtgaatttgtttcctttgagaccttaggtttgaaaagtctctttgctatctaacattcagaggcaaagttgagtgctgttaccccaaagagggatacttttgtttgtgctgagtgtggttggtcagcttttaaaacagaaatagaatttactaaaggaagtgttttctcatctgcagcatgcaaatagcgtagggtactttgacttctcttttgtgtagtattttatgcatagttttcttatgccttttataaataaaagataggctaaagcagttagaaagtatagcaaaccatccagtgacaaagtgatttttttttttgagacagtgtcactctgtcacccaggctggagtgcagtggcacgactttggctcactgcagccttgaccttcaggctcaggcaatcctcccacctcagccccttgagcagctgggactacaggagtgtgtcaccatgcctgggtaatttttgtattttttgtggagacagggttccaccatgttgcccagactggtctggaattcctgagctcaagctatctgcccaaccacctcagcatcccaaagtgctaggattacaggcgtgtgccacctggcctgaggaagtgatttttgcttttaaaatgagaacaatttctgattggctatgttggtaaattgacatttttggggggggtgggtgcgggggaaccaggtcttgtttaagatgtaccggatacaacgtatttaaagggcaagaatcctttacgttggtactttatcagaaaaagtatagtagtacctagagcaataccacccaagaatggtctgtgatgatggaaatactgtgtatccgccctgtctggtaggactaaccacattggccaatgaacacttgaaatgtggctagtgcaaccgaggaactgaatttttaatcttatttaatagttttttttgttttaaaaaataatcatctagtaaaatagactttttttgggtatatagttctatgaaatttttttttagttttgtgaatgttaacacatgtatagatttgtttaacaccaacacaaccaggacatagcgcagccctgttacccctaaaaaactccctcttgctaccattttccctacctctaacccctggaaaccactgttctgttctccatcttcccctttagttggaaagtttaaattatttacagtcattttcttaaccctaaaatcacctcaggggagggaaattaaagtttaaaagaggccttctttaaaaacacaaggacacaaaagccttcatttgatggtggctactcttatattgcatgtctttcaatactatatgtctcaactatacgtggtttgactattctgcatttttttttcatggaaaatgttatatagtattatccaaaaccaaatataatttatttccccacttctgttttggatcatttatgctagtgatttcctccatccctaagaaccagctagccaactagaattatcagagtcttagaaactttccatgccatgggtacatttcacattttcacccaaatacacagtcatcaattatcaagctaaaggaagaaataaaaatatgttcattaaaataagtgaaagatttaactattgtagacaatttaaagagagattttctatgctgaattacttttaattataattttgagtttttattttatagagcaaagcttttcactagaaattaataacacctatatttaactgcttttttgaatattaatatcctatggccatctcaaaaatcaataggtccagcactgaatttatcatctctcctttccctccactttaacctcttaatttcctcctgatttcctcctctctttctgatatcagttaatgacgccaccatctatctatccactggcccaagccagatacctttaagtcatcctagtcgtctcctttatcctatacatcttgttaggaggccctaccctcctgaatgtatcttggagctgcctcttttatctttgcccccagtattcatgtcttaattcagaccctctattgcactacttttgcaattgcagtagcctcctagctgatagtcctccctcctgtatcactccaccctactacactatcatcttccacactgcctccagaatgatccttctctaaaatgaaaatctaatcacataattctctgcttaacttttccatggcttcctattacctataggataaatcacaaccattattggcatatagaaccccataatagagcagttgcctaattttcaagcctcttatctttctctacttttttgtttccattcatctggaattctctgcctcatatatccttgctgattcctgtttgtcctttaacattcaggtattatctctcctaagaatacttttctgacccatattcccagggatgaatgggtatcccttttctgtattctctgtcctattgttcctgtgacatgttcagctttgtatcctgagaatcccagttcctgacgcacataataagtgctcaataaatattagttgctcaatgtttaattttatataattcactgctgttacgaagaactttcctatttactcgtatgatccttgtaatagccctggaagataatagggcatattttctcatttttcagatggtagaactaatgggtgtggttagctaataagtggagaattgatgctggaacttaaatcttctgactcccaacccagtatttgtgtgtgtgtgtgtgtgtgtgtgtgtgtgtgtgtgtgtgtgtcttcatcatgaatctttgtaagatgtcagccaaagagatgcaatcatgacagtagttaaattatatgcagtaactaagctacaagaatataatcattgttttataatctaattgggcaaaacaataaagatgttcttattttgaacaaaattaatagtatgctctagtgacttagggggatataggagtatatgctataaaatcctatgaatactgccttcactcataaaccggcaggcttatacttttcttgccaacaaagttatcctaattgaacattatttttatttttttaaattgacatataatagttatacatatttttaggaaattggacattttaaaatattaaacttcatattaccttttatttttctgtagctgatcctgtttcatgtataaccttttcagttggtagagtgtgaagtgttggagtaatttatgaaaggaatggaaggaaagagtagtttgtactctgttgtgaaattcttgggtgtgtttgtcaatatacatgtttcaaatgcctgataggtaccacagtcacatatgtctgcatatataactttaccattcttgtaggtacacaagacattttatgtttctttctaacaagaagagtaaaaatgaaaactaatagggaaactccattagattgagttgtctcactcttcttgaatgtggtgtgatgattattattttaaatcctgtgtgatagaatttaattaaactgacttttggaatttccttccaaaaggtatcactggaagaaaaaaatgcaactattatttatgaccctaaactacagactccaaagaccctacaggaagctattgatgacatgggctttgatgctgttatccataatcctgaccctctccctgttttaactgacaccttgtttctgactgttacggcgtcactgactttgccatgggaccatatccaaagcacattgctgaagaccaagggtgtgacagacattaaaatttaccctcagaaaagaactgtagcagtgacaataatcccttctatagtgaatgccaatcagataaaagagctggttccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaaggtaatgtgtctggtgttgattgttttgtaaggcttaggtgtctgttttgatcttttaactttttgctttcttcttaagcatgagttttgaatccatgagactagagtgcttgctgtatcattgaggtacagcatattcccaggattaaaagttaatgattataattaaaggttacataaaccttgaactgaagaaaaggcagctgggttggcaattcatggaattcaaggttcttaacacaacatgactagggtactctttacctctaatatattttacttaggcatggagaaacttggagaccatagctacagtggtcatatctcttacttgtttctagtctatgccaataacattttctgaaaagaaaaaaaattaagaaaatatgatgacaagaatgagagagaaacaattatttgtggttattgatttagaaaacagaatgttttctgaagtagcccaggaataactgaattaattatatttctttttattaactagtctccctggacaatcaagaagctactattgtttatcaacctcatcttatctcagtagaggaaatgaaaaagcagattgaagctatgggctttccagcatttgtcaaaaagcagcccaagtacctcaaattgggagctattgatgtagaacgtctaaagaacacaccagttaaatcctcagaagggtcacagcaaaggagtccatcatataccaatgattcaacagccactttcatcattgatggcatgcattgtaaatcatgtgtgtcaaatattgaaagtactttatctgcactccaatatgtaagcagcatagtagtttctttagagaataggtctgccattgtgaagtataatgcaagctcagtcactccagaatccctgagaaaagcaatagaggctgtatcaccggggctatatagagttagtatcacaagtgaagttgagagtacctcaaactctccctccagctcatctcttcagaagattcctttgaatgtagttagccagcctctgacacaagaaactgtgataaacattgatggcatgacttgtaattcctgtgtgcagtctattgagggtgtcatatcaaaaaagccaggtgtaaaatccatacgagtctcccttgcaaatagcaatgggactgttgagtatgatcctctactaacctctccagaaacgttgagaggagcaatagaagacatgggatttgatgctaccttgtcaggtaattatcattttttctttgattaccctaatgttcttttacttccattttgctgcttcttttggcatttatcaatgagaaatgattcataggcactgtaattccacttttgcaaatatgtcctatggaggtagccagcagtatatacaaagatgcataaggatgtttgtataattgcttatgatatttaaaaactggaaacaataactcgtggtgcaacaataaataactcatgatgaaatgctatgaagtcataaaacattatggtattaaagataattaatgccacaggaaggtgtctgaggtattttgttaaatgaaaaaaagctgaaaagctatatatacaatgtgatcaaaattttataaagaaatgtatctgaatttacgccatgtatatattgtttatgtatatgaataagattcctggtaggatatgaaccaaaattttaacagtgattatctttgggtggtaggataaatgtgatttttgtttccattgtgtttcctggttttataagttgtttttacaataagaatgtatgtatgtagctatgtatttatataatgggggaagccagtgctcttttaaaaacaaaagtagttgaaataaataataggattttaactataattttatatttaggcattcaaattaaactgactccagagctgtcccaaagttttcgtatttcctgacagctcttacctttgaactgaaacaaaaaatgtatattcaatggaatttaattatgtgaaattgttcttttgaaccagaattgaacctggccttgaattaaactggaaaatgcccaaatgaaattttttgcttgaaataacaattgaaacgttttacaaccaatttctggacaatataattaatctttgctatcctgattagaatgaaagatatcaaatagtagtattccctttttaggctcactaaatctgagtaaaaaattttactaaacacatgtctaaattgttatggtagattaatgtcagtgagagaggacttagagacataccattattaatttttagttcttaatttttctgttggtgacaaatggtagaaattatagaattctcactttttaaaattgacacatagttcacataccataaaatttgcccatttaaggtacacaacccagtggttgttagtatacttacagagttttccagccatcatcactatataattttagaactttttatcactcccaaaagaaatcacatatccattagcagtcattgcccatttctccttcccctccccaagctcctgataacaactgttctactttctgtctctgaatttgactattctagggacatcatttaagtggaatcatacaacatttgtccttttgtgcctgaattattttatttagcataatgttttcaaggtccatccatgttgtagtatgtattagaacatcattcctttttattgctgaatattattccattgtatggatatatcacatttttgttttttcattcaacagttgatgggaatttggattgtctccactctcttgcctattatgtataacactgctatgaacaatttgagttcaaatttttgtatgaacatatgtttttatttctcctgggtatatatctaggagtggaattgctgggtcacatggcagctaaactttttgagggactgccagactgtttttcaaagtagctgttccattttacattaccatctcaaattctcactctaatgtagaaaatctcaattttttgagatttttaaattagaatctggcctggtacggtagctcacaactgtaatcctagcacttttggaggctgaggcaggcagaccacttgaccccagaagttcgagaccagccttggtaacatgatgaaaccccgtccctacaaaaaatacaaaacatcagctgggcatggtgacacacacctgtagtcccagctactcagcgggctaaggtgggaggattgcttaagcccggaagtcaaggctgcagtgagccgtgatcgtgtcactgtactccagcctgggtaacagaacaagaccctgtctttaaaaaaatagattttagattagaatctaatctaaaaaattagattcttttttttttttttgagacggaatcttgttctgtcacccaggctagagtgcagtggcatgatctcagctcactgcaaccttggcctcccaggttcagacaattctcctgcctcagcctcctgagtagctgggattacaggcgcctgacaccatgcctggctaatttttgtatttttagtagagatggggtttcaccattttggtcaggctggtcttgaactcctgacctcgtgatccaccggcctttgcttcccaaagtgttgggattacaggcgtgagccaccatgcctggcctttagattcttttgctctaaaaaagagatacatagttctctattagaaaattcatacagaacactaaaatgttaaagggactctagtaccaaaagtctgaacgaagtgtaggaaatccataattgctgaaggaaataattatgaaaccagaagaaaaatttaagttggaaataagtgcagttatatcagggagccataaaaatgactaaaattggtttcagcaaaatttcattttacctatcaccacttaattttttttttctttttgagatggagtcttgctctttcacccaggctgaagtgcaatggcatgatctcggctcactgcaacctctgtgccccgggttcaagcaattctcctgcctcagcctcctgagtagctgggattacaggtgcacgccaccatgcccagctaatttttttgtatttttagtagagacagggtttcaccatgttggtcacgctggtcttgaactcctgacctcaggtgatctgcccgcctcggcctcccagaatgctgggattacaggcgtgagccactgtacctggcccacttacatttttttaaatttttgaaaatgacagtgtttgaaattatattgattcacatttcactacttcataatgttggattatttctcagagcttctattaaattaaaatactttgatatgcataatggattatgttgtcaataatgagcaccacataaattagttatatcagtatcaccaaaacaagttacttacattataatattcctatgcctcttacatataggaacacaattataatcatcttacatcacatatggtataaaactgaaatatttttcatgttcaaatgtggtatctgtcattacagtaagcaagggcatcataaactttcagattggattcaaaaacagaatttttttctattcacttgggtttatatttttgcaactcacatttttgcaagtgtggttcacagaccagcagcacctaggaccttgttagaaatcagactctggcccactgcagacccagtaaatcaaattctacattttaattttaatgagctctccaggtaatccatttgcacattaaagtttgagaacactgatctacataatgtgattcattgacctttaaattctaaattaaatctacattaactttgtttacataaacaagtccagaaatttgattgaaggcaataatatcagtcataacaacatttcgatcaacaatggaccacatagacgatggtggtcccgtaagattataatggagcatatatagaaacctcatataaggcatttgatattggcatagcagatcaagtaggagaaatgattgatattcattaatggtgctaggacatttggtgttccatctgaaaaaatatatataaatacaaatataaagagcatctagttttgtgtaagtacactctatgatgttcacacaatgatgaaattgcctaaagcatttttcagaacatatttccatcgtttaagtgactcatgactgtataatattaaatattataatttaaaatagctagcatttttttaggagaaaagccatataaatttatttgatcatagttttacatgacatgggagccttcagaatgaagacccaaagatacaggagaaactgcccatttttgtgcttagatttagcacaatatggatagctaaaatagctagcattttattattattattattattggagacagagttgcactctgttgcccaggctggagtgcaatggcgcaatctcggctcactgtaacctctgcctcccgggttcaagcaattctcctgcatcagcctcctgagttgctaggattacaggcgcatgccaccatgcccggctaatttttgtatttttagtagagacagggtttcgccttgttggccaggctggtcttgaactcctgacctcaggtgatctgcctgcctcagccttccaaaatgctaggattacaggtgtgagccacagtgcccagccaaaaaagctagcattttatgaaggtttatataacaaatgtgagcagagtaaaagcaacttttcaattaccttagctgatcaaactagtaaatggaattcaagagtacttgatcagtctctggcaccatgtatagcatctacctagtccttaggaactatgactgcagcaagttcagtaacttttttttttttgagacacaatctcgctctgttgcccaggccggagtgcagtggcacgatcacagctcactgcagccttaatttccggggcttaagcgatcttcccacctcagcctcctgagtggctgggactataggcgtgtaccaccacacccggctaatttttttctattttttgtagagatggagtctcagtttgttgcctaggctggtctcaaactcctgggctcaagcagtccacccaccttggcctcccaaagtgctgggattacatgtttgagccaccatgcctggcctcagtaacttttaacaatgtcttttacctcaacctactattgttaagggccccgggaatcaattattcaacaaatgattatcaggagccagttatatgccctgcatctgttagggcttataacatacatactaatggccatgatgggtaggtaaaaaaccttggcatagtgaatgtcaccataaaagaattgatagagcttaactacagtgacccatattatcgggacatgaagtgactgcattctgtgattctgctagagattagagtttaagatttcaccagaattgtaactacccattttttaagtgtaagtgtcagtgctgatccaggtctcacagcctacttctgccacccattctcagacagaaggattgacacattttgcctttgtatcatactagtcctaggtgagctataaatcttaaaagaggtagtgagaagccagacgcagtggcttacgcctgtaatcccacgactttgggaggccgaggcaggtggatcacctgaggtcaggagttcgagaccagcctggccaacatggtgaaaccctgtctctattaaatatacaaaaaaaattagccgggcgtggtggtgggcgcctgtaatcccagctactcggaaggctgaggcaggagaaacgcttgaacgtgggaggcgaaggttgcagtgagccgagattgcgccactgcactgcagctgggtgacaagagcgagactccatctcaaaaaaaaaaaaaaaaaaaaagaggtagtgagaaaaatgggagatgccttttatcctgactatctgtattatcgtttccttaaagtaaaaaggcatgatatatgaagtaatcactaaccaattaaagcaatctaaatacttgattaaattccttccattttgtgactttttatttttgtttgtttgtttgttttgcgaaggagtcttgctctgtcgcccaggctggagtgcagtggcacaatcttggctcactgcaacctccgcctcccgggttcaagcgattctcctgtctcagcctcccaagtagctgggataacaggctcacgccaccatgcccggctaatttttgtattttttttagtagagacggggtttcaccatgttggccaggctggtctccatctcctgatcttgtgatccacccgcctcggcctccccaagtgctgggattacaggcgtgagccaccgtgcccagccgtgactttttatttttaactaatttcaagcttacaaaaaaactgcaagaaatagtagagaattcctgtttaccaatttcatgcaggttccacagttaatattttacatcgtttatcattctctcttaatagatagatatacatttatatatatatatacacacacacatacatacatttttttctgaactatttgagagtaagctgcagacatgatgtttatgattattttaaagccatttttagattatttatgtattcttcacactacaccagaggctgaacttcacatcggttttgagtatcagactggaaattctttcttgaaatatttggaatcatttgtagttgttgcctcaagtgcaggaaaatcaattttcctttgaatttatttaaaagtttaagtagtgttgttacagcctgtagaaaaattaaaattaaaattaaaaaattaaaattcattgtgaccttttcacacccttactgtctctgtggaggatgaagaaggctttgctcttttgcttgccacactcacagagctaaaggatacaattttatggatctttatttagaggtcatgctaaggtagctaaaagggactacctcttatgacttattttaatataatactgtatttccagagtgtgaaaattacagatggtattccaggttacctctggtacctaaaataacgaaattgctctggaacaacaggtaaagtgatgaacagaaaaaactttttttttcattgtccaagttcataattaagtctcaatagtaattatgagagaatgaaggaaccttctggttggattaaaatggtggttttattcaaaaccaaagtgattttttttttggctactcagcctcctttttgtttttctttggtttttaaaaaagcataacagcagtactatttggtaaatttcacagtctgtgttctaaataaagttctcacaatctgaatcagtatctttctgaagtgattcaattaagaccagagacaggctaattaaggaacactttactattcaaagtgtcctttgctggaatcatccaaaatccaaacctcagtgtcatgtggtgttcccatgtgacagacttgtacacgtacctcctgaatctaaaataaaagttgaaattatttttttaaagtgtcctttgctatactcagacctaggctggcagcactgccatcaactcagagcttggtggaaatgcagaatctcagaccctaccttagatgtattgagtcagaacctgcattttaacaagctcccccaggtgattgtgtatgcattcagatttaagaggcattaatatacttatttgagaagtctacattattctgtagggaagtggtcaggcttttgttaaagtttcttccaaacttgctcatcttcaacatcctgaaaaccagctcttctgtgcaggggttcctttgtctgctagctaaatagacatgagctggtattttgtccaaggacaagaatgaacaaattagatagactagtggaaatttgctcttttcttccttttctctacaggggaggagaaaatctttggcttttttttttttcaggtgcagggatgtgttagaataatttctcctttcttgggaggtaactaatactgcagtggataaactaaaacaaaatagcagaatttcagagacttcaggggagcttctgggatgatatgagcttccacagtccataaagattctctgaatactccattgtgcaaaatagactttttgctgacttattccttgcctcttcttccactgtccacagacatattaaaatttaaaaatattatatatgtatgttaaaaattcaaacaatatagaagtatagatagaggaaatttattcatctgtctgtcattctattcctgccttaaccctattccccagaagtagccactgttaatagtttggtatgtaacccccccgcccagctttcttatgcatgttctcatctatgcatacactaaaattaaaaaaaaaaatcagcacactgcaatgctgttttgcaaattgctttttgttccacttaatatactgtgaattgctttgatgccagtatgccaatcatcaacatgatggtaaaatttcattataaaaataagaactatccattaacaaactactctgtctctcagattgggagtagagataatggctagaagaaaaaaagttttgtttattcaggtagctcagattttcctgggaattgggatgggaagtattgaaattggaagtcactgcggaggaaagtgtagagataacttaatgctaacggatagtaggaacttgctcgttttaaaggaatagattgtcagtgcctggaggtatggattgtgatgcaaggcaaggatgcaattgaatgatcaatactgcaaatgaaaagaatctttccctttctaccagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggtgagacactcttgaagcttgttattttatgtgctagtttgggagctccatcttttttgttctcttacatgttttgtaactatgttatgattcttggtaaggcctcataaagattttcagtaatgtgtgggacaaccccgatgtcctggaagccttagtgttttgctgccttagataaagttcctctcttgtttacctcatgatcacatttgtatatctatgaaattcgttaaaaaaaaatagcagaaagaaatacacgagattactattttttatagatcaatcatggttgtgttggattttaaggaacataattttttttttttttttgagaccgagtcttgctctgtcgcccaggctggagtggagtggcgcgatctcggctcactgcaacctctgcctcctgggttcaagcgatccttctgcctcagcctcccaagtagatgggactacaggcatgcaccaccacgcccagctaatttttgtatttttagtagagatggggtttcaccatgttggccaggctgatctcaaactcctggcatcaggtgatccacccaccttggcctcccaaagtgccaggattacaggcgtgagccaccacacacggcccataaattttcttctaaagctatgcctaaaactgacaaatagaatatttaagaatttcattattactatacccagaccaagcaccagaccaaaaacaagtttgtttagaattatatttttctctttgcttgtggtaaaaatgttcacaagttacttaatattgtatacaagtgttaattttaggttacacaatcttagaaaatgtataccacagttttttaaattcagtcacactcagatgttttagcttattaatttgcactcatatttatagacttcccagtatagcacagtagatttgttaaccataaagatatgtgatgatggccaggcacggtgactcacacctgtaatcccagcactttgggaggccgaggtgggcggatcgcctgaggtcaggagttcaagaccagccgggccaacatggtgaaaccccatctctactaaaaatacaaaaattagctgggtgtagtggcgcatgcctggagtcccagctacttgggaggctgaggcaggagaatctcttgaacctgagaggcggaggttgcagtgagctgagatcgtgccagccactgcactccagcctgtgcaacagggcaagactccatctcaaaaaaaaaaaaaaaaaagatatgtgatgaggtttcatgagatcaaagtcatagatttggtactttggctgccctagccctaggtgtcttaatgatacatatggttagtcacagagctaaataaagaagtatggactagtataagcttatccccaccattgagaaaattactcaaaatgtatgtagtaatcacctcacctcatatattaagggcagaacattattataataaaatgtatggtatacggagtcatcttcagttcaatattaccttgtctgcattctatgatttctgcttcagtttagcctccattatttctaactggaatgcactcaaggctaaagcttctattattctttttttagattaattaaaaaagaaaaggagggaggttgccaagcaaatgaaaatgaaaagaagcattcaaggtttctatttaatttaagaaccaactattttggggcaattcagaaatagctttcttcatgagacaagcaatgcctatgccagttacaattttttttaagtctgttaagctgatttttccaattacttccatattatcccctttacaacctcttagcccagttagaaataactttagcctagctggagtcactacattcattttgtttttaactaagtagcattggtcttctctcaatttagtctgcaacatacatatatatttatatatattttataatatatgttatatataaatatataaatgtatattaatataatatataaatatatatgtaatttatattttgagacaaatcgcactctgttgcccaggctggagtgcagtaggaccatctcagctcactgcagcgtctacctcctgggttcaagcgattttcctgccttagcctccctagtagctgggactacaggtgtatgccaccatgcctggctaatttttgtatttttagtagagacagagtttcaccatgttggccaggctggtcttgaactcctgacctcaagtgatccacccatctgagcctcccaaagtgctaggattacaggcatgggccaccacacctggccctgcgttatatttttaaaaaatgaacagaaagagttcttattatagtttgaagagtttttttaaattatctgcaatttacataagtattgaacttatgtttttgacatttgaaaaatcaaattttcccttctatttctgtttgcccatagattacattcagctgaagcaaaaagattttttcctactttctctatacctttcctatattactgacactttcccattaactgatcacctgaattgtttgataccaacaaagcccaaaatgtaagcactttatatagaaaaattagattatattaggtattttttctttttttcactgtgtatacgtttatctacttttttaatttttaatttttgtgagtatataataggtatatatatttataggttacatgagatgttttgatacaaacatgcaatgcataataatcacatcatggaaaatggggtatccatctcttcaagcatttatccttgtgttataaacaattcaattatattctgttacttttaaatgtacaattaaattatgattgactatagtcacactgttgtgccatcaaatactaggtcctattcattctttttatttgtacccattaaccatccccacttccccttacaacccccactatcctgtttacttatttaaagctattaaattaatatttaatcattttttctttttttatcaaacctcagacttgacctatggactgttgatccccattccctgtcaggtagccatcaaatgccacagaatcctagaaagaacttctatttttgctatgtagaattaattttcttcctggcaatgacagcaatagctggcctagaaaagtggaatggttgttaaaaaaaaaaaggtttgcactagtgaacagcatgactgccataaaatgaactcctttttttggttaacaagttgcgtgggactttttttctaggaataagagctttttagattactgtgtgccagacactaaaacctgataatttaaataaatgactattatttgataatattataatgtgtatgttggtatattattggattctttgctacaattatgatttcataagtgcatgagttcctttctctatttttttttttttgagacaggatcctactctgtcacacatggtgcattgcagtggcatgaacactgcttactgcagcctccacctcccagggtcaagtgatcttcccacctcagcttcctgagtaactgagaccacaggcatgcaccaccatgcccagctaatttttgtattttttttttttttttttgtagagacagggttttgccatattgcccaggctggtgtcgaactcctggactcaagcgatctgccctcctcggcctcccgaagttctgggattgcaggcatgagccgtcatgcccagccgagtccctttctctagtactctgtcttattaatttctaaaaatgctttatatttacaagatacagtctcaagcaatttcaattcataggcctaatttgcatccaagtcaaacaaaaaactgttgaactagtaaacagttataagacaattttaaaaatgtgaatactgcctggatatttgatgatattgaagaattattttaggtgtgaaaatggtattatggttttttaaaaagagtctattttttagagatacatatttaaatatttacacatgaaatgatgtgatgtctgggacttgcttcagcataatccaggtagagagcagcgagtggagggtgtaggaatgtatatgaaataagattagccaagtattatgaagcaaggtgataggtacgtcaagtttattatgttcttatacacacacacacacacacacacacacacacacacacacacacacataattgaaaatttccataataaaaagtttaagaaaaatcaggctatgttttggaatagttctaattgtttggggtcaagactggtataaaagttaaatttctccagattcaaatcctttaatacttaagagaaatcctttcatacttgataatactaagaagtaattataacattactctttttaaaaagaatgttatctgtattgtttttcttatcaatgctcttaggaatatattctatacttgtggccctgatggctggcaaggcagaagtaaggtataatcctgctgttatacaacccccaatgatagcagagttcatccgagaacttggatttggagccactgtgatagaaaatgctgatgaaggagatggtgttttggaacttgttgtaagtaagattttttgtgtgattaataaaacttccagaaaaaaaacttggtaaggttcagagaagagttgtgaagataattaaaggtggggaaaatattatgaaaattaaggaaactggaaaatggaaggataaggtatgatctaatggtactcttcaagcatggaatttaaaaagataattgtcgtatctctgttaaccaaaaaagaattgggtatgaatgaataaatgaaaattaacatttaaaatataatatgattcctatctagtagcatgtaattgaataaattccagtgcattaaagactcaaattttataaagtcataaaacctgtgtaaggcatattgatttaaagtgatcactttctccaacccagcaaatcagctgctaggattctttcctgtggaaatatgatcatatagggctgggcatggtggctcacacctgtaaatcccagcactttgggaggctgaggtgggtggattagttgaggtcaggagttcgagaccagcccagccaacatggtgaaaccccatctctatgaaaaatacaaaaattagccaggtgtgatggtgtgctcctgtagtcccagctacttgggaggctgaggcatgagaatcacttaaacccaggcggcggaggttgcagtgagctgagatcacaccactgcactccagcctgggtgacagaatgagactttgtttttttaaaaaaaggaatgtgaacattcataagattatatttattatataattttaagagcaaaaatttagaaccaatctatattaaatgtcctttaatagggaatgtttaaataaattctgtatagacatattatagaatacaatacagatgttaaaagagtaaaatagatcaatattaactgacaagtaaagatttccaggatgtattatttacttaagcaaaacaagttgcagtgtaatacttatggcataatctcatttagtaaaaaatgcaaaactacatgtatgtgtacttacatatgtatataaacacctagagaaaggactagtatatacacatgattaacactgtttatctcaggaagagagcgggattgagggagaagatcaaagagaaacttgcatcttttcaacattgaaatttttacagctagaatgtatttaaatttatttgtataacttaaaaaattaaaacaaaaaatcttgtaccaaaataagttccagtttaagcaaaaattcaaatgtaggctgggtgtggtggctcacgcctgtaatctcagcattttgggaggccgaggtgggaggatcacttgagcccaggagttcacgaccagcccaggcaacaggtgaaaccccgcctctacaaaaagtaaaaatttaggccagtcatggtggctcacgcctgtaatcccagcactttgggaggccgaggtgggtagatcacttgaggtcaggagttcaagaccagcctgaccaacatggtgaaaccccgtgtctactaaaaatacaaaaattagctgggtgtggtggcatgcgcctgtaatcccagctactcgggaggctgaggcatgagaattgtttgaacctgggaggcagaggttgcactgagccaagactgcgccactgcactccagcctgggcgacacagtgagattccatctcaaaaaataaaaaaataaaaataaaaataaaaaatttaaaaagtaaatatttagccaggtgtggtggtgtgcatctgtagtcccagctacttgggaggctgaggtgggaggattgcttgagcctgggaggttgaggctgcagtgagctgtgttcatgccactgcattccagcctaggtgacagagtgagacattgcctgcctcccaaaattgaatgtaaacaatgaaaccatgaaattactagaagaaatatttggagcattttttttcaatattatgaaactttcggacatacagaaaagtcagaagaattgtacagtagatatcctatatacaccagctagattctacaattaatactttactatatttgctttatcatacatcaatccatcaatacatcactgaaataattttagactcacaagtaagtaaaaaaaagtacagaaaatttccatgtagccttcatctagcttttcccaatgataacatctaattcatttataaaacaatattggaggctgggtgcggtggctcatgcctgtaatcccagcactttgggaggctgaggtgggtggatcacctgaagtcaggagttcaagaccaccctcgccaacatggtgaaaccccgtctctactaaaaatacaaaaaattagccgggcgtggtggcacgcgcctgtaatcccagatactcgggaagctgaggcaggagaatcacttgaacccgggaggtggaggttgtagtgagccaagatcacgccattgcactccaacctgggcaacaacagtgaaactccatctcaaaaaaaaaaaaaaaaaaaaaaagaaaaaaaaagaagaaaaaaacaatattggatttggaagcgtttttctaaaatatgatacaaaaccaataaaagaaaagattaatagattgatgaattcagatacctaaacatttcttcttgggatgaagacaccaaatggaaagtcaaaaggcaattaaaataattataattcatatcatagatgaaggttaattttttcatatacgaagaacttttatacatcaataagacaagcgtcagcaccccaaaatttcttttctatgataaaggatatgaactgacagttcacagaaaagcaaaaacaatacctcttaaacatgaaaagatgttcaacttcattcgtaatgagtaaagcaaattaaaatggcactgaaataccattttcacttattggattggtaaagttaacaattttgttaacactatgtttctgatctctcatgtattgctggtggtgtgtacattgatacaagatgccaacagaggaatttggcaatatctgtcaaaggtgaaattgcacatagcctttgcctcagaagttccacttgtaggaatttatccaacagacatttttgcatatgtatgaaatgacatgtatgcaaagatgttcattatagtattgtttacaatagcaaaatatgaggaaaaactaaatttcagtcattagggactaaaattatgatacaatcatatcatgggatactgagtagctattaaaaacaatgaaaaagaatgagtaggtttttatatgtttttaaggattaaaaaataatagcttttttgaaataccataaaactcacctttttaaagtgtacaacccagtggtttttagtatattcacagacttgtgcaactatcactactatctgatttcaaaacattttcatccccattaaaataaaactcattagtagtcattctttagtcctaatctcttacctgtactggttctactctctctaccctaggcaaccactaatctactttgtatttgtatagatttgcctattctggacatttcatataaatggaataatataatatgtggtcctttgtaaccggcttcttttatttaccatagtgtattcatggttgatccatgttgtagcatgtatcattactgcattcctttttattgccaaataatattccaatgtatgaatatactacattttgttgatttagtcatcagttgatggacaattgggttgtttccactttatgaatattgctgctattataaataatgctgctatgaacattcatatacaagtttttgtgtgaacttatgtttttaattcccttggggatatacctagaagtggaattactaagtcatctagtaactctatatttaaccttttaagggactgccagactgttttctaaagcagctgtaccatttcatatccccaccaacattgtattgacgttccaattgttccatatgcatgtcaacacttgctattacctttttattatagctatcccagtggaagtgaactggtatctcattttggtttgatttgcatttccctgatgactaataatgttgagtatcttttcttgtgcttattggcctttcataaatgttctttggagaaacaattcgaatttttaccttttttttttttgagacggagtctcgctctgtcgcccaggctggagtgcagtggcgcgatcttggctcactgcaagccccgcctcccaggttcacaccattctcctgcctcagcctaccgagtagctgggactacaggcgtctgccaccatgcccggctaattttttgtatttgtagtagagatggggttttactgtgttagccaggatggtctcgatctcctgacctcgtgatccgcccacctcggcctcccaaagtgctgggattacaggcgtgagccaccgcgcccgaccatttttgcccatttttaattggattgtttgtctttttattactgagttgtaagaattctttatatattctagatacaagtcccttatctgatatatgattttaaaatattttctcccattctggtattgcctcttcgttggcggtgttgtttagagcacagaagttttctgggtacagcataggtgcatgtgcctgtatttatgaggtatatgagacgttttgatacaggcatgcaatgagtaacaaacacatcatataacatggggtatccatcccctcaagcatttatactttgtgttacagataatccatttatactcttttagttatttttaaatgtatgattaagttattattgactatagtcatcctgttctgctatgaaatactatgtcttattcattctattttttgtactccatgttgttttcttgaataaatgcttcctagattgctgcaagcttttgtttgatttccagatttctggaaaaagatggttcttacaatttctgccagttttctcattgcttttacagaggagagaattttagaggtcttactgcaccatttgcactgatataccttcagcagatattcttgaataaatccttcttaatttgtggtatgccctttggtcaatttccagagtatttcaatggctgttttttgatacttttgtcagttttatcattgctttttgaggaaaggatttgctgagctcctcacgcagtcattctagaagtcatgcccatccattttataatttaacgcccagctaaactataaccccactcaagatatagggaaagatacatttttagacatacaaagtcaaaacacttttgccatccattaatttcactgaaagctatactagtgattatatacttcagcaggatgaaaaaaaaatccagcgggaagcaagactggatacaagaaacaataataaatgtcaaatcctctatcactgagtagtagtgacaggaatttggagacttttaatgagatcctcttctatctgggaccatatatttgttcaatgtggtataaaaatggtatcctaatgatcatatctaaagcatactagtagtgcaattaagatcttgtgtggcaaacccatgagtccttttagtaaaaagtggtaactcgggctgggcatggtggatcacttgaggtcaggagttcgagaccagcctggccaacatggtgaaaccccctgtctctacaaaaaagataaaaaattagccaggcatggtagaacatgcctgtaaccccagctacttgagaggctgaggcagaagaatcacttgaacctggaaggcggaggttgcagtgagccgagatcgcaccactgcattccagcctgggcgacagagcgagagactctgtctcaaaaaaaaaaaaaaaaaagtggtaactcatgtttaatggtggaaaaagtatattcctgaagaacaaatgctttgtctttaacaggtgaggggaatgacgtgtgcctcctgcgtacataaaatagagtctagtctcacaaaacacagagggatcctatactgctccgtggccctggcaaccaacaaagcacatattaaatatgacccagaaattattggtcctagagatattatccatacaattgaagtaagtgccaagaatttatgtttctgtgttcttacctatttaatcagcactcccgtgaatcatttctggtttgcatcagatagaggcaatgaaaaaaaatctaactcctttgaacacttcaaacaagatctgtctcaaaatttaatgtaaacgtgtctgcatttttttttttggtctttttcaggaaaagttaggcaaaggtacatttacactattaatcaggagcaaacaagttagaaccacaaaacacttaaaatatttagaaaatggaaataaagtataatttgttataaataagattcatattagttactaagaaagtgaaggatcctgcttgatggctttttgtttgttaggtcaaaacaaaagacctatttttaagttaaagtaagaaatttaaaagactaaacccagctggacatagtggctcatgcctataatctcagcattttgagaggcctagagggcacaatcacttgaggccaggagttcaagaccatcctgggcaatgtagcgagaccctgtctctgcaacaaaaattaaaataactagccaggtgtggtgccacgcacccatagtattaatcacacgagaagcagaggtaggaggattgcttaagtccaggagttgaaggttactgtgagagagaccttgtctctaaaacaaacaaacaaacaaacacaatcctttctttgtgacagattcatcctgtgttcttcaataagtcttaagtggtaatacatgtgaatgtattttaaaagtttcagtatgctatagaattggtgttcaagtgatttaaagcattttattagttcagttaagatcctatttgtatagatgacattatcattaccatttttgtgaaactagttttactgagtacctgctatgtgccagttaccaagattgcaaagcttcaacccttaattcccacagcaatgtggtcatattcattttggaggtgaggaaacccaggttaagagaagttaagttacttatccaaagtcacatagctaataactgtcataactgggatttgagcctaattactctgactccaaaagctcatgcttgttctattcactgtgcactgccaacaaatgtaagatggcagcatttcccctagcagttggaaatgtaatgtgtattactatctatggtcagataagtcttgcttaggggtagtttcctttttatactttgttttattggggaaaatgatttttgttcatgttctttttctgataaaacaagactaaatactgcatatgcaaggccttgaataatatgtttagtatggtgctagcttttttttttttttttttttttttttggagacagagtctcactctgtcgcctgggctggagtgcagtggtgcgatctcagctcactgcaacctccgcctcctgggttcaagcgattctcctgtctcagcttcccgagcagctgggattacaggcacctgccactatttccagctaattttttgtatttttagtagagacggggtttcaccgtgttggccatactgctctcgaactcctgactttgtgatttgcccaccttggcctcccaaagtgctgggattacaggcatgagccaccgtgcccggcctggtgctagcttttatggcctattaatgagaacctctactgaggacagttgtacttgagttaaactcttatatataggatacatattaactagcattaaggaaatatttatttgtttgatgaaagattggaaacaaatgcaatcaagagcaggaagcacatcttcatctttgtattccccagagtgacttgccctcagtaattgaactgttcttaatgacaataccatggcttagaatttctctatacaatatttatatgttcagtgaaataatttttttctcatgaatttccttagagcttaggttttgaagcttctttggtcaagaaggatcggtcagcaagtcacttagatcataaacgagaaataagacagtaagtactttggagtgtcagtaaaaaacagattttgactccttattacaaatttttttttgcatgtcagtttttataatatcatccttatactggatgaaatggtcacaatgtatatctctctgtagtatgtagaatctttacccattagctatttatgaccatgatttttctttttttattttttccatataagatggagacggtcttttcttgtgagtctgtttttctgtattcctgtaatggggctgatgatatatatgatggttatggaccaccactttgcaactcttcaccataatcaaaacatgagtaaagaagaaatgatcaaccttcattcttctatgttcctggagcgccagattcttccaggattgtctgttatgaatttgctgtcctttttattgtgtgtacctgtacaggcaagtgaattgttagcaaatatatttgttaataataaaaaataagcaaaatttggcaggcaaggtttattttcagctacaaaactgatgttagctagaagtctgatcattttatgccatatgctttacaaaaataatcttcaactgggtagttatttaagttgataatagatgccatttaacccctaagaaagagttcaagttttttgggtttggtatttatatctgctactgtatataactttattttatttttaaatttttatttatctatttttttttttttagagatggggttttgctctgtcacccaggctggaatgcagtggtgtaagcacagctcactgtggtcttgaactcctgggctcaagcattccttctgcctcagcattctgagtagctgggacttccaggcactagccactgcacccagctcaatgactttatttttgttatttcttcctggcacttcagttcattactttctgtatgttttaaactcttttttcgagataaacttttactttggaatagaatacttctatcaaataaatcttttcctttatctgatccttataaaaggcaataatgattttaaaaaacatcttagtttctctgttttaatgaaataagctttccagttatatttaccaacaaaaacggccaacagatttcgtagcttgtgatataccagttagtttgagttttggaaagatgggtgagttttatacaaaaaaatccttgagaaaatgtaattcctttcttagttcttgtttttgctagcctcagaaagaaaaatctgcttggtgtgatggctcatgcctataatcccagctacttgggaggctgaggcaggaggattgcttgaggccaggagtttgagaccagcctgggcaacatatcaagactgtctcttaaaaaaaaaaaaaaaaaaaaggaagaaatatctgattttccttgtattatggaatatccattggatcatagatgatagccccacaggcttgtgcagcaatttgaatacctccctctgcatgtacatctattgaaatacaaacacgattgttttggcttaatctccctttagtgtttatggattagctaaaagccaaagaaagtgactattgatactttaagttattgagatatatatgtgaatttcagcattttttaaaattcaatgattatcattcctatattgcagtttttcggaggctggtacttctacattcaggcttataaagcactgaagcataagacagcaaatatggacgtactgattgtgctggcaaccaccattgcatttgcctactctttgattattcttctagttgcaatgtatgagagagccaaagtgaaccctattactttctttgacacaccccctatgctgtttgtgtttattgcactaggccgatggctggaacatatagcaaaggtaaagtaagaaagggtgacatttgttaaaatgttgggtggataaatgaccttagtattttttaggccaatcattggaaatacatgcttttatgtagttaaccatttactgaaagacgtattttcattttggcaatattttaagttaaatatcagtttagaagatttaccaaatatggaattaatactgtagatagtacagtatgtctgtttattttaagagagacaaatgagaaatacttatcacttatttacttacattattaattgaaaaattgacatgaccacatggtttaaaataatgatagaaaaaattcacccatattcccttgctataatgtaaatcattttctaattccattctacatacctttctacttaacagagttgcaaatgtagtattcatactactttgtacccttaacactataaagtttttcaccatttttgcagtctagattattatctaatatttctgactaagtctgtcacatcagtttgctttaatttaataaaccattcaggtgtttttcaccattagattgtttctaattttttatttttagataatcctgcattgaacatactcatgtctaatagtcatttccattgagctaatatcttagaagacattacaaaggatgtgtttactgggttaaagggcataaatatttctctggttcatggtacaagttgtaacagtttttgccagcaggggtatgtcagtgaagtatttttactacaacttcaccagcattgcatcccccccacaaattctttctaagttaatagacattaaatggtattacagggtaactttagtttgtgtttcttccattaatggtggggataaacattttttcatcatcggatgtttatatttccttttgaatgatttgcttatatatgtcctttgcctgtgtgtttattgggttcatgtttttcttattaatttatataatttcttcataaattatacctaataatacttttaaaatattttgtgtacttttaggctgggcgcggtggctcatgcctgtaatcccagcgctttgggaggccgaggtgggtggatcacgaggtcaggagtttgagaccggcctggccaacatggtgaaccccatctctactaaaaatacaaaaattagccaggcatggtggcgcgcgtctgtaatcccagctactcgggaggctgaggcaggagaattgcttgaacccaggaggcaggggttgcagtgagccgagatcatgctactgcactccagcctgggtaacagagtgagactctgtctcaaaataaataaataaataaataaataataaaatattttgtgtacttcgtctttctgaagtgaaacattttctagtgaaacattttgaagtgaaacattcaaacattttgaagtgaaacattttcatattaatttttaaacaaattaatattcctaaagctgtcttttgggtaaatgctaaagattgtatttttattttagttaagacctgaactttttcttccttagcattttcaatgtgtttgttttaatttatagggcaaaacatcagaggctcttgcaaagttaatttcactacaagctacagaagcaactattgtaactcttgattctgataatatcctcctcaggtatttatcttcactcttccctcttctctttttttaacttcttaagaaaaatttcaaatatatacagaagtagaaaaaggactatcatgaattcacataatctgtctcccagatataaaaattatccacattttgccatacttcatctatccattttgtctgtctttcttgttgcagtagtattaaaccaaatttcagtcatattgttttacggctaaatattctgtgttatctctaaaaaaggatatattctgatataactatactaccgtactgtacctaacaaaatgaacattaattccttaatgtcacctaagacccaattcatattcacatttctcctgttgtctccaaaatgttttaagtctctttgcctgaaatagaattcaaacaagatccatgcatcatagcatttgactatcatatggcttatgttcttttaatctaaaacagcgcctctcttctttctcctcattgtccttccttccctcctccccacaaaacaattgacttgaagaaatagccatcagttgttctgtagaatatcccacaatgtgaatttatcctttgtttccttttggtttcatttaacttgttctataactcctatgttacttgtaaattggaagataaagctaaagacttgattatatttcattcttttgtatttctcatttttatactaataaaattgtttaggcaaagttacataataaagaaatttttagttaaatgaaacccattacattattttttaaaactttcatttttaatttaatgactgttcaaaaaaatagagtgcctactttgtgctagctactgtgctgttcactaacagtaagcaagactgacatactagttcctagtttaaatgttggttctagcttccattggcagtaattatggagccacaagcttgacgtgaactaaagagcttacatggagaggtcagggtaggaagcatattatcatggtgctttttatgttaacttatatccagtgaagaacaagtggatgtggaacttgtacaacgtggagatatcattaaagtagttccaggaggcaaatttccagtggatggtcgtgttattgaaggacattctatggtagatgagtccctcatcacaggtatgttctttcaaaggatcatgaccaaaatgttaagaaaaatagacatgaaagatgaagcactttttgtagaagctatgaataactaaattatgaacagagagaataagttcttttaagactgtattaaatcaatttcctcagatttactttgtggctttagttatgctattagtccattttcacattgctataaagaaatacctgaaactgggtaatttataaagccaagagatttaattgactcacagttctgcatgtctggggaggcctcaggaaacttgtaatcatggtggaggagaaggggaagcaaggaccttcttcacaaggcagcaggagagagaagtgctagcaggggaaataccagatgcttataaaaccataaggtctcatgagaactcactcactatcatgacaacagcataggggaaaccgcccccatgattcaatcacctcccctcctcgacatgtggggattacaatttgagatgagatttgggtggggacacagagccaaaccatatcatcccacccttgacccctcccaaatgtcatgtcttttcacatttcaacaccaatcatgccttcccaacagtcccccaaagtcttatttcagcattaactcaaaagtccacaatctaaagtctcatctgagacaagacaagtcccttccacctatgaggctgtaaaatcaaaaacgagttccttccaagatacagtgggggtgcaggcattggataaatgctcccattccaaatgggagaaattggccaaaacaaagggactacaggccccatgcaagtccaaaatccgttggggcagtcattaaatcttaaagctccaaaatgatttcctttgacttcatgtctcacatccaggtcatgctgatgcaagaagtgggctcccaaggtcttgggcagatccacccctgtggctttgcagggtacagcccctgccactggctgctttcactggctggtgttgagtgtctgtggcttttctaggtatacagtacaagctgttggtggatctctaccattctgtggtctggaggatagtggccctcttctcacagctccactaggcagtgccccattggggactctgtgtgggggctctaaacttatatttcccttctgcactgccctagcagaggttttccatgatggcttctcccctgcagcagacttctgcctgggcatccaggcatttccatacatcctctgaaatctaggcagaggttcccaaacctccgttcttgacttctgtgcacctgcaggcccaacaccacgtggaagctgccaaggcttggggcttgcaccctctgaagcaatggcctgagttgtaccttgaccccttttagccatgactggagctgaagctgctgggatgcaggatacgatgccactgaggctgcaaagagcatcagaggccctggttcccagcccacaaaatcattttttctcctaggcctcagggcctttgatgggaggggctgctgccaagatctctgacatgtcctggagatgttttccccattgtcttggcgattaacatttggctcctcgttacttatgcaaatttctgcagcccgcttgaatttctccccagaaaatgggtttttcttttctattgcattgtcaggctgtgaattttccaagcctttatgctctgcttcctttttaaacataagttccaatttcaaaccatctctttgtgaacacataaaactgaatgctttcagaataatgtaggtcatgtcttgaatgctttgctgcttaaaaaatttcttctgccaggtatcataaatcatctctctcaagctcactattccacagatctctagggtgggggaaaaatgccatccgtctcttttcttggttctttttttttttttttttttttttttttttgagacggagtctcgctctgtcgcccaggctggagtgcagtggcacaatctcggctcactgcaagctctgcctcccggttcaccccattctcctgcctcagccgctggagtagctgggactacaggcacccgccaccacgcctggctaattttttgtattttttattagagacggggtttcaccatgttagccaggatggtctcaatctcctgacctcgtgatcagccggcctcggcctcccaaagtgctgggattacaggcgtgagccaccgcgcccggccaccacccatctcttttctaaagcatagcatgagggacctttactccagttccccataagttcctcatctccatctgagaccacctcagcttggacttcattgttcacatcactgtcagcattttgatcaaaaccattcaacaagtttggctgggcgcagtggctcatgcctgtaatcccagcactttgggaggctgaggctggtggatcgcttaaggtctggagtttgagaccagcctgaccaacatggtgaaaccccgtctctactaaaaatataaaattagccaggtgtggtggagcatgcctgtaatcctagctacttgggaggctgaggcagaagaatcacttgaactcaagaagcagaggttgcagtgagccgagattgcaccattgcactccagcctgggcaagaagtgcgaaactctgttacaaaaacaaaaaacaaaaaaacctaacaccattcaacagatttctatgaagttccaaactttcccacattttcctgtctttttctgagccctccaaactgttccagcctctgcccattacccagttccaaagtcgcttccgcattttcaagtatctttatagcagtgtcctactccctgtggtaacaacttactcaatttactacattagtcagttttcacactgctctaaagacatacccaacgctgggtaatttatgaaggaaggagatttaattgattcacagttctgcatgactgggaaggcctcaggaaacttaaaatcttggcagaaggtgaagggggcaaggaccttcttcataaggcaacagtagagagaagtgccagcaggggaaatgccagacacttataaaaccatcagatctcgtgaaaactcactcatcacaagaacagcataggggaaatgcccccacatgactcaatcacctccctcccttggcatgtggggattataggtccctccctcaacatgtggggattacaattagagatgaaacttgggtggggacacagagccaaaccgtatcaactattgaagacttttatcactggagattattagctgctagaatgcataaccaaaggaagttgtctcagtttcctgtagacttgatggactttggcaaattttcctgggcaaatacctattctgcccttcctgctgtaaagactggtctaatctgagctatgacacgagtccaggttttccacatcagggtctactctaagggaataggcctggcatagttttagaaattttaggtaactaaggccaatctgaggcagaatcaaaatgatacctttccaatctcaactctctgatagtcctagaagaagctcagtttatgaaccatgtggaaataatttaggactgtgtgtttctttctttctttcttttttgtttttttgttgttgttgttgttgagacaaggtcttaccctgtcacccaagctggagtgcaatggcacaatcttgactcatggcaacctctgcctcccaggctcaaacaatcctcccacctcagcctcccacgtacctgggactacaggcgcatgccaccatgcctggctaacttttgtatttttttgtagagatcgagttttgccatgttgcccagtctcgaactcctgagctcaagccatctgtctgcctcagcctcccaaagtgctaggattacaggcatgagccgctgtgcccaacaagactgtgtgtttctcaataggggtgctattgccagtttggatggggcaattcttagttctcggggactctcttacatactgtagtacaattcagtgcccctgaccctggcactggcacactaaatcgaagtagtagcacccccttccccatcccgtgcagtcattattacaaacgaaaactccctcccacatttctaaatgttccttgagaacaggttaagaaccaatgttctaggactagggtgaaactctaaaagtatctgccaacaagagctaccatacaggtttttccagttcaaggtttatattcctggcattggcctagaactgatataaggaaaaagggaaagcaactttcacctaggcatttgttcagattctattttatatctagatatttttgacaagtaacaaataatgatatgtttcatgatagtgatcatttatgctccttaaatctatctttactctccatacaggggaggcaatgcctgtggctaagaaacctggcagcacagtgattgctggttccattaaccagaacgggtcactgcttatctgcgcaacacatgttggagcagacacaaccctttctcaaattgtcaaacttgtggaagaggcacaaacatcaaaggtaacttaactccctaggagaaacacaaactattttctttaaagccttctcagtataaatcttcacctagtttttacgttttccaataaaaattttagttgcattaatatggagttcgtttgtttttgttttgagatagggtctcactctgttgcacaggctggagtgcagtggcaccatcatggctcactgcacccttgacctcctaagttcaagcgatccttctgcctcagcctcccgagtagctgggactgtgtgtgggcacatgccaccacacccagctaattaaaaaaatttttttttatagaaacagggtctccctaagttgcccaggatggtctcgaactcctggactcaagctatcatcctgccttagtctctcaaagtgttgggattacaggtgtgagccaccacacctggccattaacatgaagtttgttaaaatatttctatttgtgctaactactaaatatactctgcattcagtatcagaaaagactttgatatgcttcttcttcttattattgttgttatttttaattctaggctcctatccagcagtttgcagacaaactcagtggctattttgttccttttattgtttttgtttccattgccaccctcttggtatggattgtaattggatttctgaattttgaaattgtggaaacctactttcctgtaagtgacttgtaataactcgttactatatgcagaacaatttgtgagtcttttgcattagtaattcattggaaataactttaataattaccaggatctttaaaggtttggagtgggagagtgataagaataatatttgcatttttataaatataaaaaatttccttttggaaaaaaaattttattatgactggtgattttccaaaagcaaataccaaacttttacatgttatgcttagtctcatttctgacatggttttgctttcacagaggactatagatatattgaggaaaacctcaggatttcagctctgtcatttactgtcaatatgatcttagactacttaattgctctctgagcttcagtttcctcaactataaagtgaggttttaataatacccattttgtgtaacttaaggttgttgtgaaggttaaataatatattagaaataatttgtaacttattaaatgctttacaaatataagatattattagtgtctactcatctagttctctgatgctgtctatggtgttgtaaagtggtaaagcagaactggactgtgcctcaaattagatatataaactttaagtcatgtaagttttactatcctcagttctcttatctgtaaaatagggaaaatagtacctaagatacaggattggaattagtataggtgaaagcatctaacatattgacagatgcaggtgacagccaagggtccccctgcgaaacccctgaaggttgaaaactttcaagcctaaaacatcctgaaggttgaaaaaccggactgctggtcccagatgaagcctgccctactcccctacccccgactgattctttctaaataatgtccacctacgcactgggaggatggggtggggcccctggaagttcaccccgtttgtatagggaaggagtctggactgacctgttcctgggtggtacctggggttcagtcggtgaggtggagagcctgttaacaggactcaatctcattttgttgagttgtttttcctttttcctttttggccaataaattcctttcccctcgcccttcaaagtgtctgcagacctaatcttttcctggtcgtgtgacaagaatctgttctttttctataacaacatgtatacatatgtgaagtttatggaagcataagcctagaaatctatgaaagccccttccagctgtgtttctatatagatctataattcttggatgaatatttaagtatttgagaacttaacctaacactgtaaaactgttactgataagagctgcagtgagccatgatggcactaatgtactccagcctgggcaacagagcgagactcctactcaaagtaaataaagtcttactttgttgtatttatttattttattttttattcaggaggtacatgtgcatgtttgtttgtttgtttgtttatttatttatttatttatttatttattgcgacagagtcttgctctgttgcccaggctggagtgcagtggcacgatctcggctcactgcaacttccacctcccaggttcaagtgattctcatgcctcagcctcctgagtagcggggattacaggcttatgtcaccatgcccggctaatttttgtatttttagtagagatggggtttcgccatgttggtcaggctggtctcaaattcctgacctcaggtgatccacctgcctcggcctcccaaagtgctgggataacaggcatgagccactgtgcccggcccgtggatatattgtttattacatgggtatattgggtgatgctggggtttaggcttatagtgaccccatctcccaaacagtgaacatagtactcaataagtagtttttcatcccttgcccccctcccttcttctcaccttttggaggccccactgctcattgatttcatctttatgtccatgtgtagccattgtttagctcctgcttataagtgagaacatgtagtatttgattttctgtccctacgttaactcacttaggataatggcctccagcttcacctatgctactcaaaggacatgatttctttttttatggctgcatagtattccatggtgtatatgtactacatttcctttatccagtccaccattgatgggcacctgggtgactccatgtctttgctattgtgaagagtgctgtgataaacacacacatgcagttgtcttttgataaaacaatttaaaataaatataagaaaatcctttgggtagatatccagtagtgggattgctgggttaaatggtagttatattttaagttcttggagaaatctccagactgttttccgtagaggttgaactgatttacattcccaccaacagtatataagtgttcccttttctctgcatcgttgccaacatctgttattttttgatttttttaattatagccattctgactggtgtgaaggggtatttcattgtggttttaagttgcatttccctgatgattagtgatgttgagtattttttcatgtgtttttttttatcacttgtatgtcttcttttgagaggtgtctatttatgccctttgcccacttttaaatagggttgttttatccttgttgatttaagtttcatatagagtctagatattagtcctttgttggatgcatactttgcaaatattttctcccattctgtaggttctgtgtttattctgttgattgtttcttttgttgtgcagaagctctttcgtttaattaaatctcctttattaatttttggttttgttgcaattgtttttgaggtcttagtcataaattctttccctaggataatgtctagaagagtttttcccaggttttcttggggtttttatagtttgaggttttacatctaagtcttcaatctatcctgagttaatttttttatatggtgagagatatgagtccagtttcattcttctgcatatggctagctagttttcccagcaccatatattgaatagggtgtcctttccccattgtttgtttttgtcaactttgttgaagaccagttggttgtaggtgtgggctttatttctgggttctctattttgttcagttgatctacgtgtctatttttgtatcaataccacgctgttttgattactatagtcttttagtataatttgaagtcgggtaatgtgatgcctctagttttattctttttgcttaggattgcttcggctatttaggttctttttccatatgaaatttaggattgctttttaaattctgtgacagagaacattagtagttttataggaattgtgttgaatctatagattgctttggacagtatggtagataggattagggttagacatggagagaagatcatctcctgccacacccttcccccacacctacagtgctgcggatgcagcagtgctatttcccaccaggggccagctagcgcacacttggacaaagcatatttcatgcttttcatggtggctccacccctactgcaagtgagtcacgtgccgcttgggttttttccaagggcgaggctcaactccctctcccgacagagtggcactgtcccagcaaggagggacagacaaatcactgagttgcctgctttggtctgggggaaaagactaacccaaacccattttagtggtagctatcagaggggcatactcatgggaaccaaaggacaaagtccttatgaaatgaaggtcaggagccctataacaagggcacaaaagagaagctgatcatgttcttgctggcacaggatcaggagtgcgagtgcaccctaatataatctcttcccaccacccctgcatcagggcaggtgcttctacctggcaccaacctacctgctgtctcttactcttgagtgccatctactggtgtgtatcctgaactgcatcataaaatttaaaatctgctaacagaagggcttagttctagcccttaagataagtccacagggacctctgcaccctaaaccctataggagattgttagctctaatggctaatacctcactacaaaaagcagcatctgagaaagctatggcatagaagctatccacaaccaagtaatctgtacagcaccttggacccctgaaagcaccaaaaacaaagctaaatgatcacacacaacatgcaccacagtaaagcacccaagggaaaaaaaagaaggaaagaaaacgtcccttggaaatgatagcaaattcaaaaacaggaagcaaaagttcccttggatgggaaagaatcagtgcaagaactctagcagtacaaaaagtgttttcacaccgccaaacgattgtaatagctctctagcaacggatcctaagcagacagataagtaatttaaaatatggattgcaaggaaacctcaatgagatccaaatgaaagttggaatccaatgtaaagaaaccagaaaaacgattcaggatatgcaagacgaggtagccatattaagaaaaaaaacaaatggaactgctggaactgaaaaattcagtaaagaaatttcaaatccagagaactcctgcaagacactatacaagatgaccatcctcagggcacacaggcattagaatatccaaagtcaatgcaaaagaaaaatatcttaaaggcagctacagaaaagggccaaattacctacagagcaaaacccatcaggctaacagcagacttctcagtggaaatgttacaagctggaagtgattgagagcctatttttagtttccctaaagaaaaaaaaaactggcaaccaggaatttcatatcctgccaaattaagcttcatacatgaagtagaaacaaagtcttcctcagacaagcaaacagtaaggaaattcatcaccaccagaccagagctataagaaatgttcagagaagttctgaacatggaaacaaaagaatgatacttgctaccacaaaaacatatataaatacaaagctcacagaccctataaagcaattacacaattgagactacaaagaaactagcaaacactaccataaggaacaaaaactcatatatcaatattaaacttgaatgtaaatggcctaaatactccacttaaaagacatagagtggcaaattggaataaaaaaacaagatccatccttttgctgtcatcaagagacccatctcaaaggtaataactcataggttgaaggtgaagggatggagaaagatctatcatgcaaatggaaaacaaagagcaggggttgctattcttgtattacataaaacagagtttaaatcaacaatagttttaaaaaaaggcaaagaagggcactacaaaatgataaagatctcaattcaacaagaagatttaactatcttaaatacatatgcacccaacattggagcatccagatttataaaacaaatactgctagacctacaaaaagaggtagactgccatacaataatagtggaggacttcagtaccccactgacagcactagagagatcatcaaggacaaaaattagcaaagaaactctgcacttaaattggattctcaaccaaatggccctaatagatatctacggaatactccactcaataaccacagagtatatattcttctcatatgaacatggtacattccctaacattgatcatcggcttgatcataaagcaagtctcaataaattaaaaaacaactagatcagatcaagcgtcttcctagactccagtggaataaaattagaaatcaataccaagaggaactctaaaagccacacaagtacagggagactaaacaaccaactcctgaataacttttgggtaaacaatgaagttaatgcatttcggccgggcgcggtggctcatgcctgtaatcccagcactttgggaggccgaggcgggtggatcccctgaggttgggagttcaagaccagcctggccaacatggtgaaaccctatctctactaaaaaatacaaaaattagccaggcatggtggcacgcacctgtaatcccagctacttgcgagactgagggaagagaattgctcgaacccaggaggtgtaggtttcactgagcctagatcacgccattgaactgccgcctgggcaacaagaacaaaactccgtctcaaaaaaaaaaaaaaaatctctgttcctgatgacatgattctatacctagaaaaccataaagatttctccaaaagactcccagaccagataaactacttcagtaaagtttcagggtataaaatcaacatgcaaaaattattagcatttctatacaccagcaacgtccaactcgagaactaaatcaagaactcaatcccatttacaataatcacacacaaaacatacctaggaatacatttaaccaaggaggtgaaagatctctacagagagaagcataaaacactgatgaaagaaactgaagaagacacaaacaaatggaaaaacattccatgcccatggattggaagcattaatattaaaactaccatactgtccaaagcaatctatagattcaacacaattcctataaaactaatgtcctctgtcacagaattaaaaaagcaatcctaaaattcatatggaaaaagaacctaaatagccaaagccatcctaagcaaaaagaataaaactagaggcatcacattacctgacttcaaattatactgcaaggctatagtaatcaaaagcatggtattgatacaaaaatagacatgtagatcaattgaacaaaatagagaacccagaaataaaaccacacacctacaaccaactgatcttcaacaaagttgaccaaaacaagcaatggggaaaggacaccctattcaatatatgatattattatatgggattacagacatgagccactgtgtccagcccactactgtaatattaaaaagtttctttaagtgattcatgtctgtttagtacacactgaacaaaaggattgttgggaagtttttttggtatttatttatttatttatttatttatttatttatttatttatttttgagacagggtctcgctctgttgcccaggcaggaatgcagtggtgcaatcatggctcactgcagcctcaaacttctgggcttaagcgattctcttaccttagcctcccgagtagctgcaactgcaggcatgcaccaccatccctggctaattttttttttttttttgagaccgagtttcgctcttgtcacccaggctggagtgcaatggcatgatctcggctcactgcaacctctgccttccaggttcaagcaattcttgtgcctcagcctcccaagtagctgggattacaggcatgtgccaccatgcccagctaatttttgcatttttaatagagacggggtttcaccatgttggccaggcaggtctcggactcctgacctcaggtgatccacctgccttggcctcccaaagtgctgggattacaggcgtgagccactgtgcccggccatacctggctaatttttcacaaattttttttgtagagatgaggtcttaccatgttgcccagggtggtctcaaactcctggcctcaaatgatcctcctgccttagcctccaaaagtactgggattacagatgtgagcccgtgcacagaccagcaagtagcttggaatgtgtttccttcaggaatttttctcatgagttcaggatgtcttagatttcttctaaaactaccaattatatttttcccacatgagcaaacactgaacgtcactaagagcttaattagcagatatacttggttcacattgttatgtccaaaaggattttgttgaaatatgactaaggtccctttgcatgccatgtgattctttttcattgtctttcaagaatagtgtgaaaggcagaattatggttttactctacagagattgagaattctgtttattcagtatcaaattttttgaaaattatgtctcacatttgcagctatttctgaaaatttctaataaaaacattcattctcaatatggagcacttatattcagtccatagtttgtaattctggaatctcagtatgtcccaatttcttatattcataaaagaaagaaagtgttttcttacctgtaactaaaaaatatatgtaggtagctaggtaggatatgtcactttttaaattgtggttttatttaaatagtgttaagttttgtgtcttttgttttgtacagctctaaatcaataaccaaaatttatgcctttcttctaaagggctacaatagaagtatctcccgaacagaaacgataatacgatttgctttccaagcctctatcacagttctgtgtattgcatgtccctgttcactgggactggccactccaactgctgtgatggtgggtacaggagtaggtgctcaaaatggcatactaataaaaggtggagagccattggagatggctcataaggtaagacagtccccagaactaaaacctgtaccaccaaactatcaatagcacccctcacatgtgagaaacacatactcctaaattatttctctgtggtccatgagctgagctgcttctaggactatccagagatttgaggtaggaaaggtgttattttggttctgcttcagattggcctttgttacctaagattcctaaaactactccaggcctatttattagagcagaccctaatgtggaaaacctggactcctatcctagctcagactagactagtctttgtggcagaaagacagaataggtgtttgcccaggaaaatttgccaaactccagcagccttctaacctatttgtgtgtgacttgttttcttcactgggaccttcaattgcagtgccgtttctttgcctttgctgccaccagccgacagtttgcagctatgactttaggaatataatcctatctctgatctcatattaggatttccataatcatctcaaagctacttgacttcaactaaaaccatgtttctactagtatgttcttattatgaggatgtaagctatgtacagaggtatatagtaaacatagaacatatcttagaacaaatctggaaactcacctcgccagagaatacaggctagtaatttttatagacattttaaactttgatataatttcaaacttaaaagtcgcaagactagcctggcacagtggctcacgcctgtaatcccagcactttgggaggctgaggcaggcggaccacgaggtcaggagtttgagaccagcctgaccaacatggtgaaaccccgtctctactaaaaatacaaaaattagctgggcgagttggcacacctgtaatcccaactactcaggagactgaggcaggagaatcgcttgagcccggagggcaggggttgcagtgagctgggatcgcgccactgcactccagcttgggcgactgagcaagactccatctcaaaaaaaaaaaaaaaatgttgcaagactagtacaaagaactcctatatgccctttactgcagtcgttgggctcttttcctaagaataaggacattctcttatgtaaactgtagtacaactatcaaaatcaataaattaatattgatatgttgttatctgatctgtagtccatgttccagtttcctcagttgtctcaataatgtgctttatagctatttttcccctgtccagaatcatactttgttggtttatttttcttttctttctttctttctttttttttttttttgagatgaagtctcgctctatggcccaggctggagtgcagtggtgcgatctcggctcactgcaacctccacccaccaagttccagcgattctcctgcctcagcctcccgagtagctgggattacaggcatgcaccaccatgcccagctaactttttattattagtagagacggggtttcaccatgttggccaggctggtctcgatctcctgacctcaggtgatccatacacctcagtctctgaaagtgctgggattataggcttgagccaccgcacctggccatttacctttattcttataatcatttccctactgcttagatttcctcatcagatctataattcattatattgaaagcctttcttttttaccttgaggcactagaggcgtctcttaattacctattaacagtcaacccttaaaaattagctctagttgtttaacatatattcacagttatttagcatgaacaaacagttcagcattggcagaggagagctgttgtgtataactaagagtatttcttcttttattttcccgaagaccatcagttttttaagtcaaattaagtcaaaggtcagtttactaagaaactaaatagtcatctctttgtcaaaacagacctttttcttatttctggaaaggtgatgtggaggatcatcaagtcattgtatcttaatttttttacaggtaaaggtagtggtatttgataagactggaaccattactcacggaaccccagtggtgaatcaagtaaaggttctaactgaaagtaacagaatatcacaccataaaatcttggccattgtgggaactgctgaaagtaacagtgaacaccctctaggaacagccataaccaaatattgcaaacaggtacatttttttcctcttgtttattagtgtagtcatctcctgtaggaattccccggatcaaatctagtctggtgtttgactgtgatttgcatatatagttggtatgaggctaaaaagacttgtattttctcatttaattgtatgtaacttatttcttcatacagacaagtatacagatgaaaacaaatgaactataatcctatcacacagataactcctgttgacataaaaaattaaaatagaagttatacatatttgtggtaggacaattcagatagttcagagaattacataatgaaaattgtaaacctcattccctgcccccttccataattcctctctccaaagtttaacaactgttaacctattaacagtcttttaaaatgacagctttattgagatataattcatatactataaagttcacctttttaaagtgtacaattcaataattttagtatagtcataaaggtgtgcatctgttaaccgtttttaatgcatatagccacatatacgtatttatcatcttttaaactttatacagaaaggtcatacaatgatcaatctttgttaccttgcttttttattttattaagtgaattttcctgtcaggaaatgcagatctgcctcattgtttttaatggctgtattatactctatagtgtgagtgtttgtttttttttgacttttgcagtatatactcaacatccttatcagtttttgcaagtctgtctctacattaaatgcctatcaatgcaattgctaagtcaaaggatgcatgcagttaaattttgatgaatgctaccaatacccatatgatgaatattaccaatatacatgaggggttataccaatttatacctgcaccaaaagttatgagtgctcatttccccacattcttaccaacgctttatttttattttctcaatttaataggtgaaaaaatatttacttgatggtttgctttgcatttccttaattatgaataaggttgagcatctttttatatatgtattgaccatttgaatttcttttcctctaacctgtttgtatctatgacctatttttccacagagttgtttgtctttttcttattcatttgcatgagttctttatgaattgtctcacattaattttacacttaaaacgtggcagtttctaccattggtgttgccatttatttatttgttctttctcttttacctattacctattactgacctggcttccttacacccaaatcaaacagcagagaggatgaagctataaaaagctaggaaacaatgagggcccccagaacttttcggcttgctaaagatgtagactatagagcagatggagagcctccggtaactaaaggccctatactttgttactctttgccctgtactgagtagaaaacctgacttgactatggagttaaaaatttaatttgtaattatctactggaaagagcagagaatactgataagctttccatgttttctataaattttagagagtgggattaaaacaaagatttttttttattattgtttttgagacagagtctcactctgtcacccaggctggagtgcaatagcgcaatctcaactcactgcaacttccgtctcctgagttcaagtgattctcctacctcagcctccctagtagctgagattacaggtgtgcaccaccacacctggctaaatttttttgcacttttagtagagacagggtttcaccattttggccagcctggtccctctgcccacctcggcttcccagccggcttcttcagctgggattacaggcatgagccactgtgcctggtcaaaacaaagactttgaggctcttctgtaactttgaatgttatgtttgatgctctattcctttgtccttatcaaaatccactgtcaagtaggcaatatgtgacaattttattataaacatttagaattaactaggggtttttatcttgctaatgaatgaccttgcattatcagaacagtagaggaaatccttttgtttctgtttgttaggagctggacactgaaaccttgggtacctgcatagatttccaggttgtgccaggctgtggtattagctgtaaagtcaccaatattgaaggcttgctacataagaataactggaatatagaggacaataatattaaaaatgcatccctggttcaaattgatgccagtaatgaacagtcatcaacttcgtcttccatgattattgatgcccagatctcaagtaagctaattttctttgtagtaccaattatggggcagttatgaacagatggctaactttataaccctgaactgttatagaagaaacaaaaattggcatcataatttcatttcctcaagtcaataccctatgccttctgatcatttaaattagtcaagaatatttcccaactgtggtcattgacaccaccatagggtgatgaggtctagccttagctgatcatccatgatcattcttttgtcactacaactactccaaaccttttctatctttcacaagatcctgtgactctctcctttgtccctctgcaaattatcttattttttatatagaaaattatggttcttgggcatgtgttcttacatatttttgcccagaatcattccttttttcagggaaagcagtatccttcatcttgcctaatgaatcccttcatctagatcccaccctctcttgattcatcagggacctccctctttctgttaggtccccttgctgctttatttttcatctctttctgttttagcttcttttcttaaacatataaacatttcttccatcaaaatcactatattcccatctagattttgtcctttcccatctatattcccatatagattctgtctttttcttttatatccaagttctagaaatggtaatctaggtttgttgaattcacttactccacagtcatgcctcagttcattgcagtctggcttctcccccatccatactactgaatccgttctttctaagttaactgatgaccattgacctcactgctctctccagtggtcacttttcagtcctcatcctgcaagacctcattaagatatttgacaatgttgaccatcccttccttcctaaaggatgattccatgaccctgctttgtctagattctcctctcacctccctggctgttcctttttttttttttttgagaaggagtcttgctctgtcacccaggctggagtgcagtggtgcaatctcagctcactgcaacctctgcctcctgggttcaagcaattctcctgcctcagcccccaggaagctgggattacaggtgtgcgcagccatgcctggctaattttttgtatttttagtagagatggggtttcaccatgttagccaggatggtctcaaactcctgacctcaagtgatccacccacctcagcctctcaaagtgctgggattacaggtgtgagccactgcacccctggctgttccttttaattgtcctttggttcctcatttctcttgctttcaaatgtcgtatgtcgtcagggttttgttctttgtctttttctcattttataatacatactctctctgtacaatcttattcatgctcatcacttagtctaccacccacagacttccactaccgctctaaaatccatatctttagctaagtcctgtttccttggctccatgccgatctatctatctgcccccaaaacatgatctacccacctaagtgttccaacacctccctcccgatttgtgcctgagtgattttgctaacatggaaatctagtcgtgtcactctctaaccagtaccttttattacagtgttttataagctgtttttgagccatagacctttggaggaatatgatgaaagctatgggcccacccctcagaaaatttttgtttcaagagatgcacatgtatcctgaaacccatccacgggtctctgttaaggatcccagctttaatgggtctctctctcctatgggacaaagtccagtctctctggactttgttttagatctgttccccatgatatgtctcctgcctccctgcatcactcatcttctttttccactaccgcatatgtactccatgttccatccctacctaactacttacagttcttccttacggtgtgtcatttccttattagatcatttcatttaccattttctctatgtaatgttcttgttcacaaatggcatctatctcgtgaacttacgcttatctttcaagacccagcttatatctctctcttcagtgacaccctcattgactgacatatattgacagaggtatttgctcttcttcctgaatcataactgtacttaatctctgttactgtactaggacagtgtatgataattatatatttacctgcctgtttctactagtctgtgacttctttattatttgtctatgaacttctagtatcaagcacagtgacaaataggaaattcatttgacagcttttattgagcacctactgtgtgtcatgcactgttcaaggcactaaagaatcggcagtaaacaagataaactaagttcttatttcatggagcttacattcttggtggaagaacacaagagagtgagcaaataagaaaatacaataattccaatggagatagtgctgtggaggaaaattaagtggggcaaggggcataggggtgctgggagtagtgggttctgtttcatatagggtgatcagggtaggcctcactgagaaggtagtgtttgaacgaagatctgaggggatgagagaaaaagctatgtggatttctgtggcaaacacgttctaggcaggagaaatagtaagtaccaaagcctttagtcaggagtgtgcttgacttgtttgaggaatggcaaggagaacagtgtggcaagcgcagagtaaatggatgggcaaggggtataagacaaggtcagagaggtggtttgggactagatatgtaaggacaaaaccaatatgacagttttgagtagaggagggacaaaatctgacttaacattttaaaagtaaaccgggcgcggtgactcacgcctgtaatcccagcactttgggaggctgaggcgggtggatcacttcaggtcaggagttcgagaccagcctggccaacatggtgaaaccctgtgtctactaaaaatacagaaattagtcgggcgtggtagcaggcacctgtaatcccagctactcgggaggctgaggcaggagagaatcttgcggggattcggggcaagggcagaagcagggagatgagttggtggacattgtcataatcgaggtgaaacataatggtagcttggaccagtatagcagaggttgtaagaaatgatagaattctagatgtgtcttaaaaggagagtcacagatttttctcatgggttggatatatatggcgtatgagacaaacaggagtcaagaattatgccaaggtttgtggcctaagcagttagaaggatggagttatcatttaaataagatgggggatcccacaggagggacggtattgggaaaaagatcaggagttcagttttgtacatgttaagtttgagtacctattagagatatcccaagtggtgatatcatataaatggaaatatgaagtaagcagttggctacataagtttggaattccaggaaacagactgaatcagagagatggatttgggagtcctctgcttatagatctgtggtgtctaggaaaatagccactaattatatgtgactctttaaattagttaatttacatttaatttaatttaaaattcatctttcagtcatactagccacatttcagtgctcaatagccacatctgtgtgttagtggctattgtattaaacatagcagatatagaacatttctaatatcacagaaagttctcttggactgcagtggtatagatggtatttaaagccatgagactggataagaaccccaaggagtgagagtagataaagggaaagagagagttaagtactgaatcctgcagcactataaattaagaagttagggagatgaggagggatgggcaaagaaggccaagaagtggccaattaggaggtaacccctaagaatgtggtatcctagaagccaaatgaagaacgtatttccaggagggagtgaacagctgtgttaaattctgctaataggacaagtaagatgaggaatgagaattaactattaggattattaaagtaaaggtcactggctgtaataattcactggagtattagagtcaaaagcataaagcttttgactaccccaataaatggggtaggttcacaagaacatgggaagatatgaattggagacagccaatagagatacttttggaaagttttgctatgtacagaagcagataaatgtggtagctagagaggtgggtgagatcaagaaagggtttttttttttttttttttttttttaagataggacaatgtacagcagagaaaagttgtgcaggagtgggcggggagaattgttgggttggagagatgttctagaataggcaaaggagcgggggtgtctagtgcacaagtagaaaggttggccttaaattaggagcagaatcagtttataataacagaagggaagctagatacacagacacaggaggcacaggtagttgagtggatgcggcaatgagagctgtggaagttcttttctgattgcttctattttctttctgaagtaggaagcagagtcatcatatggtattaggatggggcaggagaagttggagatttgaagggagatgagaaggtatgaaatagccacctagaagaaatggagaatgaatggactagggaaatatagttaagttgccagatagcactaagagcccacttaaagaaaatgagatgtcagcatgattgtacatgttcatctagccacattcagctactgatgcacagtaagtatttttaaatttgattgaatttttatggaaggtcaaagggaaagcctcaccaagaaagtaatatttgaactggctcttgaagaatgtgattgagtttgctgtctggagaggagggataaggacatttcagatgaaggcagcaatgtgtgcaaaggcccagaggcatggaagaacagagtatgttcttagaaaatttgaacatcactgttggaggctatgttctaggagcaatacaatgtagtgactgtgcaaggttagacaggaagaacttgcttcatggggttttataaagattaattgaacttactaaatgttatttctgtgcctactttcagatgctcttaatgctcagcagtataaagtcctcattggtaaccgggagtggatgattagaaatggtcttgtcattaataacgatgtaaatgatttcatgactgaacatgagagaaaaggtcggactgctgtattagtagcagttgatggtaaggttttccataagtatgctataactcaatgttttgttattgttttattaatttatttatttttgagagacctctgaactatgagggttattcaaaagcatcttgaatgcaaaatgaaaatgtcaacaacacatgattattactgattaatttaaaattctctcgcatttgcctgcctttgttactttcttccctagcctatgttttaaatgaaggctaatcaaggattttttaaaacctaaaaatagcaacagtaaaataatagcaaagtaaaataatattcgtaatcccatcatcctaacacaatgtcaggttttttttgtttgtttctttgttttgtttttgttcttgtttttgttttttttgagacggagtttctctcttgttgcccaaactggagtgcaatgatgtgattcggctcactgcaacctccgcctcctgggttcaagcgattctcctgcctcagcctcccaagtagctgggattacaggcgcgcaccaccatgcccggctaattgtttgtatttttagtggaaatggggtttcaccatcttggccaggctggtcttgaactcctgacctcaggtgatccacccacttcggcctcccaaagtgctgggattacaggcgtgagccaccatgcccagcccacaacgtcagttttaattttgtatattccattcctagttttcttgaaatgtgtgtgtgtttgcagaattacagtattagtacatataccattttttactgggtacattttatcgtaagtaaattttacctcaataaagttaaaatcacttgtacacatactattttattatgctttattttacttaatgctttctaatgttgctatataattttactataatactgcataatttatcaatcttacacactataatcattcccctcttgttggaaatttaggctattcctaatatttcactattgtaaatgacactacaataaatatctttgaggttgtatgtgctttattttgttatttcttagggtaaatttctagttgtgagattaattccactctacatttataatgtctgctaagtatgaaggcagtcttttactatggcctttttaggtctgggaagaagcagagaataccattttacttttgttttgtaaatagaataaaataataagatttatggtaatatttttcccactataaagtgcccattttgtctctctctgcccccccccccttaccttaaaaagaaaaaaagtattaatcttcagtttcatttgcctataaattagataaagtgtttgaggctgttggcaaatacctttctgaggaacaaaaagggtcttctaatatccagtaaggtctctctttttattttcctgtgattactttattagtaacccctacctcactctgaaattttcataaccaaatatggaggcttgttacagagtttgtagtataaagtctgtgtgggcttagagatattttaagttaagccatgccctgaacaactttacttgagaaaattcatttcattctgaaatttcaagtcaaaatgttattctcctttcactatattccaagttcttttattttgtgctgcccctatattagatgagctgtgtggcttgatagccattgcagacacagtgaagcctgaagcagaactggctatccatattctgaaatctatgggcttagaagtagttctgatgactggagacaacagtaaaacagctagatctattgcttctcaggtaattgataggggtatgtgataacttctaattattgatatacattttatatcttgccttcaaatgctaagaaatttacattacctactattttcattatcactgagtagtcctatctggttccttcaagaaaatttaccatgctttgctggaaagactttgggctttgtgtgttgctgttatacgtaaaaaggtatttgcttagttcatgggatgcttgcgtgacactgtacaccaatttctgttgatgtgccctttgaaatgttgctcatattctttaccagtgctgccaacctaagctgggctctcctgatctcatgcctgaaacacagcaatagctccacacacatccctctctagtccatcctaaataccaccaccaatggaactattttcctaatgcaccactttgacataccatttttctgctcctgactcccacatctgccttatctctaaaatttttcaatctttttaactttggaatgccttctcccctcttctaataaataatgcaagtaatcttttaatacattcttttgtttcttttttttttcttgggacggagtttcgctcttgttgcccaggctgaagtgcagtggcgcgatctcggctcatcgcaacctccacctcctgggttcaagcgattctcttgcctcagcctcccgagtagctaggattacatgcatacaccaccacgcccggctaattttgtatttttagtagagacagggtttctccatgttggtcaagctggtcgtgaacttcggacctcaggtgatccgcccgcctcggcctcccaaagtgctgggattacacgtgtgagccaccgcacccggcctattaacaccttcttatgtaaaaaatacagaaggatataaagtaaaaatgtcctcttttccccatgctccccattcagtcctactgcccctcacactgccactttttcatatgcatatatgtgcatatacagagtacatatacagtataattctggtcttttcaacatcagatcattttgaacagattgttcagtagtttgctttttttacgtaacagtatactttggagcttcatccatatctgaacataaagttattttggccgggtttgttggctcacgcctgtaatcccagcactttgggaggctgaagtgggcagatcacatgaggtcgggagtttgagaccagcctggccagcatggtgaaaccttgtctctactaaaaatacaaaaattagccgggtgtggtggcgcatgcctgtaatcccagctactcaggaggctgaggcaggagaatcgcttgaaccaggaggcggaggttgcagtgagccgagatggtaccattgcactccagcctgggtgacagagcaagactctgtctcaaaaaaaaaaaaaaaaaaaagttacaaagttactttattctttctatactgaattccatggtatggatgtatcataatttatttaaccatttccctaatgatggacatttgggtggttttgaaaattttctttttgcaaacaaggcaataataaacatctttggacatgtatctttctgtacatgtgcaagcctgtccaagatagagctagacatggaattgctagaccaaatgatgctcacattttgatagatgctgccagatgccctccaaaaagagttacaatttacacaccagccactggtgtataagagagctcatttctccacatccttgctatcactagatattatcagtcttttaaaatgtggacatcttgtgggtgaaaactgatggcttgttattgctcagttatgtttcacgtactcattattttttaaatgaattgagtttattttcatcacataggttggcattactaaggtgtttgctgaagttctaccttctcacaaggttgctaaagtgaagcaacttcaagaggaggggaaacgggtagcaatggtgggagatggaatcaatgactccccagctctggcaatggctaatgtgggaattgctattggcacaggcacagatgtagccattgaagcagctgatgtggttttgataagggtaagtgccatggcttgacctttgaggagtatgagactgccctatgtggtcaatgataatgtcataaagtatattgagcataacaattctgtcttaagttccatgctatcagccattaagagtttaagaatatggagtgggattatgggaagtcatgctaatttaccccctgactttctcaacccagctcataagcaagtgagaattataagtttctgaagtgaagaagaagatttaagaatggattcggaataaaatgatcttcaacaaatagttgctgagattattttaagtagatttaatcatagtaccagcatacacccctaaaagtgttttcagaaccctgaggaaaatttttgaaaaacaccttcggaagctgagtctaagttttagcattatctgagatttgtaattaattcacatattaccctaaggtagacgtaatcttcaacatacacagtatcaaatgtaaaagttactggttaagttagagtctcttactaatatcacaaatatttctgttcttagaatgatcttctggatgtagtggcaagtattgacttatcaagaaagacagtcaagaggattcggataaattttgtctttgctctaatttataatctggttggaattcccatagctgctggtatgtgactcttaactagtactgctttttccactaaagttattagagacctaacatattggaagcctgtcttcttactattagttttgagcttagtttttgtttgtagcctactggtatggtgagaggtaatgttaaaatcaatcattttaattttcagtaatgtttgttatagcttaagaatatataagcattctgacagatttatttttttccctccaacttttttttttttttttttgagacagagtctcactctgttgcccaggctggagtgcagtcatacagtctcggctcactgcagcctccatctcctgggttcaagcagttctcctgcctcagcctcctgagtaactgggactataggtgcccgccacaacgcccaactaatttttgtatttttagtatagacggggtttcactatgttggccaggctggtctcgaactcctgacttcaggtaatccacccacctcggcctcccaaagtgttgggattacagctgtgagccaccactcccagccttcaactttgtattttgaaaaatttcaaacttgacacctgaatgctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaactccgtctccaaaaaaaaaaaaaaaaaaaattcatacctccaaaaacattgaaaaaaatggtacaataaaaatctgtatgcctttcacctaaactcaccaactgatggtattttgccacattgcttcatctctttctgcatatatttgcacagagatatgtatttgtttgcttattaatttttttctaaatagatttacctttaatctgactacccaaacccaacactgtttgcaagattaattcatggagcaaatgatttttaaagaattatacaagtattttcctctagtcttttttttactctacatcagtttttgtcttgttacatagttgtgattgtagcttatggagaattttctgctcttcacttaatattctattatagtcagctggtattttttttaggttgagagaccagatgacagagagagtgaacaaagcaatataactgagaaaaaagaatttagagttatttaataagcatctgagaatctcctaaacttagggacctggtaggagttagtaatgatgacataaaagaaataagtattgttttcttcttgttctctctggtttgagggccaaggaaagacaagaaatgacatgagaacaattacaaaactgtttatcagcaaggacacacaaatactgagagaacaaagaacaaaagaacaatctaagtccagtaagattaattcatggagcaagtgatttttaaataattatacaagtaatatatgatcaccatagaaaaagtagaaaaatataaagaagcacataaaaagttaaaagtatgagtctatttcatcctcatcatgtgagcaaacattcttatgtctgtgaaaaccaagtgtggatgagtttgtagaacatgaactcccatacgctattggttggattttgaatcactacagccactttggagaacagctgaggaatatccacgtaaagttgaagatgtgcccatgttatgacccagtagtttcacccctaggtatataccccacagaaactctcaaacatggacacggggagacatgtacaagaatgttaacagcaacactctgttagtgaaaaaaatggcaacaacaaaaatctctaccaccaagaggataaatgctgaagaagtatcaaacaaagaaatgatttgtatgtatgttagaaacacattaataatctgtttagtattatctactctaactaatccatacttgtttcttaggagtttttatgcccattggtttggttttgcagccctggatgggatctgcagcaatggctgcttcatctgtttctgtagtactttcttctctcttccttaaactgtaagtatgatagcttgctcacatttgtattttgtattcctgttatcatctagtcattcttggtaggttttattcttgtattgatcaatgataagcccaaaccattcttaatgagaattattattagcggccgggcgtggtggctcacacctgtaatcccagcactttgggaggccgaggtgggcagatcacctgaggtcagtaatttgagaccagtctggccaatatggtgaaaccctatgtctactagaaatacaaaaattagctgggcatggtggtagacacctgtaatctcagctactcgggaggctgaggcaggagaatcacttgaacctgggaggtggaggttgcagtgagctgagatcgtgccactgcactccagcctaggcaacagagtgagattccatctcaaaaaaagaaaagaattattattagctaacagtaataattagctatgtaattgttacttcgtgtactttatgcatagcaaccacaagcactgagtgggataaaatatagtgcactaattctgagaagtagggtttctgatgatataactccacacaattcgtttcaagctattttcctaccagtgatcacctttatacatttcataccaaaactaagtgtggatgagcaaatcttctttcttttctgcatgtagcgagcatctcatttacttttggttatttgaaactagcatacttttgcatatgtccagttacaggaaaccaacttacgagagttatgaactgcctgcccggagccagataggacagaagagtccttcagaaatcagcgttcatgttggaatagatgatacctcaaggaattctcctaaactgggtttgctggaccggattgttaattatagcagagcctctataaactcactactgtctgataaacgctccctaaacagtgttgttaccagtgaacctgacaagcactcactcctggtgggagacttcagggaagatgatgacactgcattataaaaggccatggagagtgctgccagtttaacttgtcatgcactgacacagcattcatgatgttaccttcacttttcaaaatattgtagaaggatttttctcatgctcttatattagggattctatttgagttgcgtttatctgttggcaaaaatatctttttcaaggcatcagctctgaacctagctttatttaaactgaatttccagtatatttttgttttcactaacaacagataaggtagagcagtgaggtttacaacaagccctacaattagagattgctgaactgctgctaaagtgattttttttttatttgaccaaaaaaaaaaaggcccaagaagaagaaaatgaaaaatttgaagatttgagagcatgaagatattcatgcttttgaactcaaaatattgaagatactctcaagcctgtatccctgccccactggggagcaatgactttcaaagcactgtgtataaaacatctagttttagaagggaaacagttgaaactgtttaaaaatagatgtgccttatttattgcaggctttctttcccccattctccctgcatccttgtccttgcaggtgcttttttagatgctccaatatgtcttcttttgttattttctttcgagctaaccaagtttaggtggtttttcattgattaaaaataactgacaactgttctaatattttgctcctttttaaattttgtagctcaaaagaccttaaaggtctgtagggttccctgcctcccatctttccactgttgtaaaaagtatatcaaattattccttcaagtttcctagctctgtgctcagtttcagttcactcctgccaagttggactctaagttattcttcatgtagtctgctgatctcagtctggaaacttaacattatgagccttttctgctcaaaaaattttcaaagattaaaactattatacatatacaggtcatataaaattacctggattcactaaatttgtttgttgttgttgttgttgttgttgttgttgttgagacagagtcttgttttgcagcccaggctggagtgcagtggcaccatcttggctcactgcaacctctgcctaccggattcaaggaattctccctgcctcagcctcctgagtagctaggattacaggtgcctgccaccacacccggctaattttcatatttttcagtagagacggggtttcgccatgttggctagcctggtcttaaactcctaacctcaggtgatccacccgccttggcctcccaaagtgctgggattacaggtgtgagcctccatgcccagcctaaatttgtattttttgaattgagtataatcactttgctagtatatataatttaatagattttatttatcttttagtgtttcagataacctctcaaaaagactttaaaataatgctattacacaaagctgcatttaccaaaaaatacagtaaaatcataatacagaaactaaaatttccctaggttatgacgctttttagctaaatatatactcttctctagtttaaaacatttgaacttgcctagttagtgtggttggcaaatttaggagcttgttcccattgccaaatggatttagaaattcccttgtgagtgcctggtagctaatacactggtcagagatctggtacttgtaagactatttaaatttctttgttagttgcaagatggatttcatatgcagaatatgtaaatgaagaggactcataagtaaattcctaacattttgttcccattaccagaagcaaagctgctgctaacccaacatctggcacataggatttgtactcggtaaatgttagttcttttctccccttgaggtcagtaataaatacaaaaaaatcatttttctagagcagagtcttaaaatcaggtgggggtaggggatggagttcttcctttcctaccccttttctcttttatcctttcatatatacacatgcaaagtttacaaccttattccatgctgtctttcagatttagaaaagatctaatttctgtctcagctgtcttaaagagagaactgaagcttttgatgaaggtgctattaatctagaaaggcaaacccatttcactgaaatatcaatgggtttgcatatctaggccctttttttagaccaatgcctatgccatcctccatgctttcagtttgagttttattatttattattttaattccagtggcccatcttataatacaacttgtttcttctagaagacagagctgatagggtaaatgttgaaaaaagaagcatgcctccttctccctcccacccacctcaagcagttgaacacagccagttattcttccattattatgtgtaccttggagtcatcctcttggtcttgtattcatattgtgggacagtgggaatagcagcttgtagtattgaaataatcaaagagataatttcagctcttacaacaagaacagaaaacatgctaattagaaaaagtcctgctttaagtaatatgtagccacatttgaatcctctaccacaagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggaaatggatttatatttgaatttgatatttgaatatttgaagttctctatttatatttcatttatcactcttctgtattcactcagcaaccatgcccttagtctgaagataacaaggatactttaatatccagtgccggttcagactcacctatgtggcaccttaaacttaaatatccaaagatgccttttgaatttcaaagattaaaacacagctagagtagtagtattgtagtctcaagatgtatggtgtgtcatttgtgaaaatagaaacgttatttttcctagtttagtatcaacattttagaatgtcaaatttgatgccttgtgaacaagtaattttatattgtgctttaattttttaaaaagtattctttattcatatgtatagaatgcttaaaatagcactgtagacaagatgtttccaaaactttaagtgcgcatatcttttctgtatacagcttaaaatcaaaaatgtatgttaagagaattttttctattacttatggatcatgctttaaaatgatttttcttgatatttattttactccattttgtttttttctctgggtgaggcatctggttactggttattttaaaaagaataaagacattcctggaatcactccttttgggtttttgtttgttttgtttcttttctacatttttaagtattattttacaaaatagaaaaaatatagattcatgccaaattattacctatttttacactaactttctgcagtccctccatctggtatgagtaaccagatagagcacaaagcatgagttcttgttcttcagttaaaagagcttctttcacagtgttgataacaaatgccttttgtagccaaaaccaggcgtctcaaccttacgtttttagttaaagaaatgtttagctaaacgttgttgaacattgattgtttggtaccgaaaacagcagtggacgatgttgtgcaatatccatctactgtagttaagatattcagtagtttgtttttcataagcatgtaattgatcatatttctgccaaggatgtgccttcaactttataattatagtgttgtaaaatatttttgtctgtctcttttgttaaatcatccaaccccctctatcagcagttctgaactacctttgttatatttttatttttttcaacttttcatctatgatggaggtggattataggcatcactacactttcggttaggatgggagggaagaaatctattttccttcggactccactacacctgccatatcattcagtgaggatgagaaataaaggaaggaatattattgttctgctttcctttgtagtctctaatacattcttgatagaatgtctactccaaatgagctaaacagagaaaagagattttcttgccattggggagccctatacagagtgtttgaagttcccacccaagatacattcccatacccgaacactcctttttgagttaaggaaaccattgtaaacttgtgaggaaaaactaattttcatttccccccaaatccttggggttactcagggtgaggagataggatgggaaatggcaaaataagagtaaaatccccaaggcatccactcagcttgccagcctccctttcttattggtatcctgacctcagagaaggatgtgtactgatggctacctcccaggtgaaccttcaaaaccttccagatcaataaaacaaaacaaaaacctttctgttggagaatccttgctagattaaggcatcaaagtccctgctcaaattaaaaggaaatagagctgcatctttcacaaatttgactagggccagccagccctacttctttaacagcttcaccatcctagatgtgacccctggttgtacaaatgaagtgagagacaaaaggcaaggcttttgaaggtgaggtttaagtgaagttgctagtataaagagggtcttgtgcagtttaagaaatctgaaaacatctatacggtcagtcaccctctggaaagtttgaaataggttgagtagtctttggcatactgtacctattgccctcaatggccccaagctttccattgacatcaccttctctgcccactaaggcctgcctataaactgaagtgctgccaatacttcaaaattatttgcttcacctcacccaatcaaaactccaatttctttttaaaaaaatcttaattgtacatattatggggtacaattcagtgttctgatacatgtatacattgcataatgatcaaatcagggcagttagcatatctgtcacctcatgcatttattatttctttgtggtgagaacattcaaaagccccccttctagctattttgtaatatacaattaccttactgttaaccatagtcaccctactgtgcaatagaacaccagaacttattcctcctatctaattgtatctttgtacctgttgaccagcctctctccatcatcccctcttttcacccctacccaacctctggtaaccactgttttactttctgcttctatgagatcaacttttttttagcttctgcaaatgagtgagatcatgtagtatttgtctttctgtgtctggcttatttcacttaatgacatcctccaggatcatccatctttctcaaatgacaggatgtcattctttttattgctgaatagtattccattgtgtagatataccactttttcttcaaccattcaactgttgtcaggcatttaggttgatttcaagtcttggctattgtgaatagtgctgtagtaaacatggaagtgcagatatctgtgatgtactgattttgtttcctttggaaatacacagagtagtggggcttctggatcatatggtagttctatttttaattttttcagggacatctgtactgttttctgtagtggctgtattatattcccaccagcagtgcgtaagcatttccccttcttgccacatccttgccaacacttgtttttttaataatagccattctaaattaacagagtgaagtgacaacctacatagtggtagaaaatattcacaaactatacatctaacaaggggttaatattcagaatatataagaaatt

SEQ ID NO: 11750 - DNA, 98567 bp, Human
attatttttattttatactttaagatttcttttataatgtattaaaaagtaaaagtacttttaaaaatttgtgcccaacttcaagagcattttaatttttttgataactatgataattcagataatttgttgaactataagattgatatagtaagtttgaaatttcacttgaatctgaactgattcgagggcttctatctatttaattgtttcctttccccatacccatttctttaataagtggattatgtaaaaacagcttggcaccttgttaccagtaacatcttagttttacccacaagtttggagattttacactccctttttgagatagaaacatgtataaatttccacagagtaatagtggaacagtgttaacagtgctatcttgatatgcaatttattattaaatcaaagtttgaagtagccctttttaaaaggactttaaaaacatattcctgattaaggaagttttcctgatcatttttattcctgttttcttaacatgctttttattttatttcattgttggtagctaggtcatgcactgtgacagttttatagtagctatcttatttgcataggtttttggagaacatatgatggaattttaggacattgtcctcaaagacttattacattcagattagctatttaaaactgttttgtatttgtggctgtggtgccagataacaaggtctaatttaatatattttagcatttgtgacttgagtagtttgcaagagacaatgtaggaaataaatttctctagtagaaagaaagggaagcaattgttgattcgggtatcaagctgccagttactggctattgactttgggctaaccacttaagtaacaattcgatttccttatttgaagactatggggttagtgggaaggttttcaatagcactaggattttgtcattttgtaattagtttttctatgtgctcttttcatacccaaccatagtttttacagatcattgaattatcacattgattctatcacattaattcttttgttcttaatttacttaaagaacacgtttttaccccttgtgggattactggtaaatataacattgaatttctttttttccccaatagatgcaatataggaatgtacttatattctccttaatttagaaattcattttaaaataaaagattaatttacctcataataatgcaaagttgtttttttttttttttttaggttttctttttttgagtgcttggttgtttggagcttagttgtttttttggtgggatgcgtgagagatttctaaaatagtgcttttaaacatttgccacagctccatggatagtttgttttaaaaaatactttcccccccaacttagtcttaagtagaatttttcttctaaaattgaacagtggagtcaattattttatttgtccaccttctccctgcctggggtactgtttctttaactggtgttaaccaaccctctgtgtccatgaatgtattctgagagttctcacattttctatgagatttaaaatttggggttttactgtcaacgataatcttgagaaggtaatataagctttttctgggtcatctgaatcatttgccatgcaactagatactaccacatggtaaaattagtgttggtgtttattattgtgttcatggtaatgtgaaggccaactacttcatattatctgaagtgtatgaggctttcactgagattcaaataacaaacagtgctaggagcatccctgcttgccacacccaaaagaacctgcattatagagataacattcaagttgtaggcagaagaaagattacattttttaatagagcaacttgtaacaatcattagaagtaagtgtatcagtaagtacaaaaagaattttctatacttgcttctagtgataattgaataaggcacacatataatgcagaattcaatatggctgtgataccaaccatatctttaagtgacttccttaaattagtgttcaaggactgcttgttagtggttttgtttggaacgaggtctgattatccttaactggttaaggaagccatgaggttatcagtactgttgtgtacagtgcatttaggtgaataggtattcttttcattagaatgattaaagtaaaaacaaaaacagaaagagattaaatatattatcaaactcaaagctttgttggtgttgacatttcagcagaaaaccgttgttcattatgccatattttttactgttaatttgaatttaattggttaggtagttacttttgtatttaatttataaatttgttttggctttgtctttttatcagggtaataaatgctaagttttgttttgtatgtattaaaataacatattaaaagtggtttaagttggcattaggagtgtaagaacacatttttcccttaaaagttgtatatctagtacttggtttgagaaacctcagtctatgatactgaacattattgtatcataatcatgatagctaaccttcaactagatgttttctatttcattttctatgggttgcttaaaattgtgacttttctccttttctgtcattaaaaaaattaatttctctaatacatggctacctaaaatcatgacataatccactgatctgtgtgtgggtagttgcatattcaaaatattgttatctggcctgatttttagtttctgtgatttttgactgtcatttctattttaatattactattttgggttcatttttcattcattcatacattgaacaaatgtttttaaaattccactatgtacaagggattgttctaggcactggagattattgggtgagaatttttttttttttttttttttttgagatggagttttgctcttgttgccaaggctggaatgcaatggcacgatcttggctcaccgcaacctccgcctcccaggttcaagcagttctcctgcctcagcctccgaagtagctgggattacaggcatgtgccaccacacctggctaatttttttttgtatttttttttttttaaatagagacagggtttctccatgttggtcaggctggtcttgaactcctgacctcaggtgatccgcccacctcggcctcccaaagtgctgggattacaggtgtgagccactgcgcccggccaagaatctttatatttgggtgggcctatagtctctcttcactgtcagattttctaattgtttaaatgaaaaatttcatgtttatattacatagtacatatctatttcaactaaactaaatctgtcttgctgacatatctagatatcttagtacttggtgttaccacgtcatgattgccatagacataaatgtctctttagtccaaaatgatgggtcttttaagcttgttcattcaaacgatattactgaaagactggtaaattcaagaggttgtagtaggcactattggactactgatgaaatgaatgagacagtctgtgttcttagcagaggagcttagaaattttaatccagtcactgaacccttgaaactaatttgggctttgctgtgtgttgacattgttgtatctatacccagaattgcagactcattgattacagaggggcttttgcatttaataaacattcattcagtaagcatttactaagcacatacatttgtttctggttgatttttatcttctttaatttgtctcttagccattacgatgacccagatatcttgccttggagtgttcagaataatagggtagaatctgtaggacaaggttcacaaacagctatttctaaacaatgcttcttggaggtaacaatttgaagaatattgttgtaggataattataattataggtaaacttcctaaatctggaaaccttggaacctgtcatattctagaaccataaaaatagtgctgctttaaagcaaaagcagaattagatagagggagatgtccagaagagatgcaagaccaatgacagccttggccaaccctgtgggatctgtgcaatcagaatgactcttttgccaactagttgtccctagttgggctgaaatgaccaggcctttgtactctcacactgatcaatcagtggatgggagatgccaagcatgacctcagtctaggaagttcactgcagataaaacagaccctaaagggtgtgatagctgaagtgctgatatctgtcagccaacagatttcttagtaaccaaggcaacatggtgggtgatcttcacaaatgggtgatctgggcttcatgcatcatagtgttcaccctaggcagtaaactgtgacgattaccttgatgacaggattgcttattcagtgttctttttcattttctacctctggatcatgagtagcctaatttacgatgctaatatgtggtggattaggtgtgagtaaggggaacaccattttccctttactactttcaacttaggtgttaatatttggtaactctaataataaggtgactataacccttggtttacccaggttagtcctgtttgcctagaaatacccagtttaagcctgttgaaaatcagttagcttaggagaaatacctaatgtaaatgatgagttaatgggtgcagcacaccagcatggcacatgtatacatatgtaacaaacctgcacattgtgcacatgtaccctagaacttaaagtataaaaaaacccaaaaaaacaacaaaaaaactatcttctcaactagtacagagactagattaaaaaaaaatcagttagcatctaacatctgttaattatttttagtaactcctcacagtctcagaagtatcccagtttgtatcccaatacaagataaactgtattgtcattctacttagtaattttttaaatttgcgtgcatattcattatttaagcatttttctggcctgtctaatgaatagaatgttctgttttccattttttaagaggcagaaatggtcttctggattagctttgtatttttgctttagttgaccctaaaacaaatgcgttttatctttatcaaatttttcatcatcaagctttaatatattgtgaaatcacaacatattctatcaagtatactatgactgaaattactggatgtattatttatttctgtctcccactgttacaattgtgtctataatgacttttatttccctggtttattttgtagcttagtcacaaatatttatgttcttatttatctttctgctcagagactgggacctgagctgtttccctgatggagtcaatcattttccagaaggatattccgacctattcaaatctaggtcctgaggaaacacaacttgcttagaaatagacagttttaaatctgcttttacagaaatcttttacagaaatccataatggaaagaagaaatttaattttatcccagatagatttaataacttgcagatctactttgttcatagataaactctaaaactaattaaagcttctgaaaaatgtctagggacagaagaaacagattcttagtgattcctttaacctatcaggaggtaataggctgtcaccttaagtcatgctttttcgttttcttttttttttctcattctgtctcccaggctgcaatgcagtggtgtgatcttggctcactgcagcctctgcctcctgggttcaagcgattctcctgcctcagcctcccaagtagctgggtttacaggcatgcaccaccacacctggcagattttttgtatttttagtagagatggggttttgccatgttggccaggctggtttcgaactcctggcctcaagtgatccgcccacctcagcctctcgaagtgctgggattacaggcctgaaccatcacaccggcttctttttcttaattgtttctctgccctcttttccctatttttctggtctatagttgtggctgaatgttagatagggaatagggttcactggtggactcaattttacccatttctaattgcttagcaagaggagtcacctgctgattttaatatgaagtttagtattgtgtaatggacaatatctttaacagatggtgtactgccagtgatgtagaacttcttaatcatgctccctttacaaaagaagaacactattagaaagcgatggtatgattttatacttgatcttcaacaagtgagaaattgataagtcaaatatacagtcagccatctggcattccacacatgttttcattgacttgggagatcatggagttatacaaagcaggagtagcacaatataagaaaatggcatgttatagaaatatttatttcttttattttagttatctatactattgatcagcaacaagtttatcagaaattttcattttattcagctatctgagtttagaaagaagtaattcagatggtatttacttttttttgcccaatcaaagctgctaggcattgaggaactgtttcagagtgggcatagttttttccttcacatgaggtcaaagccactaaccactgaattaaacatttgctgagcttggtttgcagcactttgattgatatagattccttcttgcaacttctttgagcctccgaaacttactgtgtcattatagaccccaactgcctttaaaagataggaatttcaacatcctacaatttagtcatcatttggatgaatgacttaaattattatatattttaggaatattaattttttatactacctgagctaagctgtgtgaaattattatcttatgacatacacactatttaatatattgaatttcagaaagttggttccaaatatcaaatagctgagtagaaagtagaaaaagacaatccagttgctgagaatggggcagaaaaaaaaaatgtgatttctaaatccaaagaaactagctccccttatctaatttatcctttcaaactaaaaatatgttaaatgctgtcagtgtgccgggtaagtaagtgctaagcactgacactccccctccttgtccttatggacctcaggctgatcctctttgttcccagcctggctcactgtcactctctccagcattcctgtcagtgtccacatggatggtcttttcaatattctggcttctcagcttcttatccttttcttctctggtgatcttatcctccatcctacatcagcttttcattcttacagccatactcttgtcattagcaataacagtggtctctgcataatctcagtttgaagcatcctcaactctgattagcattttgaatctcactgtagctcactgcttctagtacctccattccaacaatcttttgaccttattgattcttaaaagccacggattttaccaccttgttgctgtctttcatttccctgattacctttctttcttttacatccagtttaaatttcatgtcaatatttgcttggcaaaatctaattctagttaaatccatctctctgtgtaaatcctgagctgaatgtcactggagcaaaacatgccatgatgcaactggtctttaagttcaaggctgggaagttccggggcactcatgttgcctgccatcatgctgcatgttccgggtccattcggtcttccattctcccagatgactatttcatacttttttccccctcctcaaaacagcttctcccatccttattgttaggtaataatttagttttgcattttactgaaaggatagatgccactaataagaacttggataagctcttatcactgcatatatccatgtaccaccatcaatgcccatatgccttctttcctcctgcactctgaaagaatgtaagggttcctatcaacccctccacagtagatcccttcttctcttgtcaccttttcaaagacacggttccagttattattccttctctccattttattaattttctcaaaataatcagtgttctcttctctactgatcattcccatcagcctgcaaatatgctgttattttttccatcttaaaaacctgtcttgctgggtgcagtggctcacgcctgtaatcccagcactttgggaggctggggcgggtggatcacctgaggtcaggagtttgagacaagcctggccaacatggtgaaaccccatctctacgaaaaatacaaaaattagctgggcgtggtcgtgggcgcctgtaatcccagctactcgggaggctgaggaaggagaatcacttgaacccaggaggtagaggttgcagtgagtggagattgtgccactgcattccagccgggtgacagagcgagactacatctcaaaacaaaaaaacccaaaactctcttgaccccatattcccctctagtgactgctccctttctcttctcttctctctctctcttttttttttaagacagaatttcactctgttgcccagggtggagtgcagtggtgccatctcagctcactgcagccttgacctcctgggttcaaatgatcctcccaccttagcctcctgagtagctgggactacaggcacgtgccaccacacccggctaatgtttttattgtattttttgtagagatggggttttgctgtagggtcttgaactcctgggctcaagtgattctccgaaagtggtgggattacaggtgtgagccatagcgcctggcttcttctctcttttatagcaccgtttctccatataattgtcactactcattgtcttcaatttctctgcttctattctctattctcacttgaagtcactgcaattaagctttttttttttttttctcttctctcctactttgcagaaacggtcatgttaaggtcaccaatgataaaatcctcagtcctcatctcactttttaatagcagtatagacacaagttaatcactcttttcttggaaacacttccttttgggacaacacattctcctcctggttttcctccaaactctggcttgttttccttctcaacttggctgatttatgtctcacctgcttgtcttgttaacattggagtatccaggctacaatcttagatctcttcttttctctctatttaaatttactaggtaatcttatcccatcccttgttattaaatgctgtctttatgctgaagacttccaacttatatccaacagtctaattgatagctctacctgaatatctgagggcatctcaaagtaaacatctccaaacctgagctgctgatctctcacccaacatgcttcttcacagttttccctttctcagttactgggaactctgtccttcaggttacccaggccaaaagactttgaatcatccttagtattgctgtgactcatactgcacatccatttcatcagcaaatccttttagctctatctttagagtatatccagagtctcacaccatttctccaccttctctgctattatgcattgttatctcttactgggattattgcagtagcagataatcaatcttgctgtgtccacccttgctattgacaggctattcaccaaatacgagtcagaaggatcctgttgaaatgcagctcagagaatggcatgaccgtactcaagaacttcctgtttttctcactcacctgctctctgactcgctctcacagtaaaagagggtttacaatgtcctccagggccctgcttgatcatctacccattccatcctgtaactccttgactttatctcctactactctttcttttactctagaccaggcaatctggactccttgcccttcctctgatatattaaacattttcttaccccatggtttttgtacttgatggtcgctctgcccagaatatttattctctcagatatatgcatggtacacatcctcatttatttaaaccctttgcttaactgtcacctctcagtggggtcttcccaatgtccttaaaaatcatagtagtttccctccctccatcacctactcccctggttcatcatctaacaaactaaatatttccttcatttattttgtttttattgcatttcttgtgactagaatgtaaacattcatgaggaatgttttcgttttgtttgctgctgttaggaaagtgtctgtataatattaagtagtttaaaaacatttgttgaataaatgtatgaattattatagtcttttcagtgttataatttttctattacacataagaaatggagccttagagtgtttagtaatccgtggaggtaacacttaaacccaggtctttcttggctcatagtgcagtcactcatgtattttttcatctatcaggacacttacagggtactacaggaactttacattggatgaattgcattataagatagaggaagtcatcaatattgtgtgtcttatttgtgctcttctcctcaatcagtatctgggagaaaatagaaaccgatttttaacagttcatgttgaagcactttttgctacatcatagaaacttgtcagagagacttgttaaactatttcctcaaatcaaacatgttttggggtaagagagttctgagaaactcacttttttctgctttctattggcaacaaggctatatttcttaccgagatgaaaaatatctaaatcccatgaactagcaaggaatcaataagaatgctgctagtttggttaaggtggttcaggtattccagggctgtgaattccatgggagacagctggaatttacgttcattttctaccactgagtttttggttcactggaatcatagattttcaaagattatcaagctactcacagtcaaatagggaattgatgaggaatagaggtcacaatttcagaagatagtcacagatcatgatgagtatgaatcatgctttcagtttttgcagctgcttatagcctggcaaactacaggatgtgtctggtcggcatttcccaacacctgccccatgtttcgttcatattcaaaggaaatgattaagctaaaagtgaattctatatatgaaaaagaactggtatccttggattatggaagtgaaatatgaataccaggtttctcccaaaacatttggttacatggccagactgtggctattgtctttgtccacccagaatcctgaaattataatttctaatgaaattctggcatgagctgagaggtggtgaaacgtcaagtgagaattgaattatacgctaataaaattgtacctagtggttcgaatggatcgtctaaagggtttatcaaacttctctaatttgaagggtctcaaactccaaaatctgcctccttgttggtgggcacagctcttttaactgggagagattatttgctgctgggcttttggagtgtcctgtgggcacaagtgttggcaaggatttgatcagtttttgcacagattttggggctcctccatgctgtgcccttcttttagggatttagtctctcaattttcaaccactggtagccacagactattttctgacacctcagatcaaccagactgagtctatttgtttgaattttagctgtcctgactcatagactggggagtccttttgcaggacaaggcttatgaacgtcatggtcatccactgggcttaatttctttcaagagtcaagactccagtttatgcctacttttggcccttcaatgcctttaaatagttgtttgttttattttgcccagagtttataatcattaaatgtggaaaggatagtctgaaaaacgcaactctgacattacgttcagaacctcaataagatattttgtatagttttttcattattattcaatttaaaataccactttctaattttcattatagtttcttctttgagctgtgagttatttagctatttattaaaaaaaatttctagccaggcccggtagctcatgcctgtaatcccagcaccgtgggaggtcgaggcgggtggatcacctgaggtcaggagttcgagaccagcctggccaacatggtgaaaccccgtctttcctaaaaatacaaaaattagctgggtgtagtggtgggcgcctataatcccagctactcgggtggctgaggcaggagaatggcttgaactcaggagtcagaggttgcagtgagctgagattgcgccattgcactctagcctgggtgacaagagcaaaactccatctcaaaaaaaaaaaaaattctaacataagaattttttgaatgatctttttattgatttctaacttaattacactatggtcagagaatatatgtaattttcatcttttaaaatttgttgagattggatttgtagtccagtatatggtcaattgatgtcagtgttttctgtttaattgaaaaggatttgtattctttgcttctgggtgcagtgtcctttgtatgtcagttaggccatgtttgttgaacatgtttaaatcatctctatttttcacactccctccttttttttggtatgccttttttgtcagttattaagactagtacattaaaaaatcatctcccactatgtggtgattttgtccatttgtccttttagttgtgttgcttttttccatttatttggagcccattgttagataagtatagatttagaattatttatttcttgtgaattgaaccctttaacagtatgcgttttccctctttatctctggtatgtttttttcctgaaagtctactttgcctgctattaatatagtgacatcaactttcttttggttaggttttttattgtctattttttccttcttttttcttttttttaacaacctttctctgtctttagagtttgtgtttcctttcaaatagttgggttttcctttcttttaaattagtgtgacagtttttattttcattgaaacattagattacttacaattaatacaattattaattggatttaaataattcaccttactatttttttttaatagagacaggttttcactatgttggccaggttggtgttgaactcctggtctcaagtaatcctcttgccttggcctcccaaactgctaggattacaggtgtgagccaccgtggctagccatactctttattttctgtttcctctacctgttctatacttctccatcccattattagtttactgaatttttaaatgtattatgcatgacattactctcatttgccacattaacctttttttcttttctattttaaggaaaagatagagtttttaataccccattgtgtgaacaaggaattgttggatttggaatcggaattgcggtcactggagctactgccattgcggaaattcagtttgcagattatattttccctgcatttgatcaggtaagtgaatgaacatttctaaggttgttcattcattgaaatattcaagtattgccgctacccttccacccacccttacctgcattctaaacattttattatccttttactaatgtattacaattataattttgttatgagcatatatttaaagatctaatagaatagtttaagcagatagattgggattgggtgaagtggctcacatctgcaatcccagcactttgggaggccagggtgggaggatcacttgaggccaagagttcaacaccatcctgggcaacataatgataatgagaacccatatctacaaaaactacaaaaattagcccagtgtggtggcacatacctgtcatcccagttactctggtggctgaggcaggaggataacttaaaccaggagtccaaggctacaatgaactgtgatcgcagcactgcactccctgggtgacagaatgagaccctttctcaaaaagaaaagaagagagaaagaaagaaagagcgagagagaggggagagggaagaagggagaggggagagaggagaggagagaggaagggaaagacaagaccctgtctcaaaaagaaagaagggaagggagggagggagggaaggaagaaaaggaagagagggagggagggagggagggagggagtgatgggatcctgtctcaagaaagaaaggaaaggagggagggaaaagctcattgtgctatgggaaaggaaggaaggaagggagggagggaggaaggaaggaagggaaagactcattgtgccatgggaaaggaaggaagaaaggaaggaaggagggagggagggagggagggacgagaccctgtcttaagaaagaaaggaagggagggaaagacttattgtgctatgggaaagaaaggcaggcaggcaggaaggaaggaaggaagagggggagggaggcagggagggagggaaagactcattgtgccttgggaagggaaggaaggaagggagggagggaggaagaacggaaggagattggaagggaaggactcattgtgccatgccccgtctttctttctgaccctcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtatgttcatttatgtactttatttgatttctatttgatgtttccattttgattcattctatttaatatctatgcttatctagaggaaagaaaacaaacaggattcttggaatttatgtgaacttaactgtatttaagaaggggaggttagcagttcttttaagtatgctatccaatgcccagttttacagcaagttctttttgaaggaggactggttttataaactctggcattgattaattttatagacttcaaagaataagaccaagaacatagttggtttacctcccctctctttcaaagctttatatttctttctaacttaagtctttctcacttaactgatgatggggtgattttaataaatcttttgtttagtctgtatttacctcaaagtcacagggataacacttttgcttttaatgtatttcttacttgttaaaaagactaagagaagactgttacctagattttttttttctgtttaaagttaggtaatacttgctcaaccaattaattttgaagcatctcctttttataacctgtctttcacaaaagcttaggtcttttgatggtaaaaatattttgagttttttatgtcttaattttttgtattatcttttctgtttctgtttactgaataagcttttcaggggatcattgtagaaacccatagatgtgtgaatccagagatgtatatttgttttttgaccacatgaattgattgtgagcatgtgtctatgttttattctttttttcttatttgttttttctaccagatcaaagttataagcttatcttagttgagtagatgttgcctgatttttgaatgtgagctagaagttgtagactgggaaagaagccatgtgcgaggcaagttatttttgtgcttgagctaaacattaattcacatttaatatttataacattatattgtttttaagaacagatcttttctgtctgtcccctgccttctcttttcctccttcattttctttcttcctcttcctttttcctttttttttcagctgaaatgaaaatatacttaaagtacaaaaggctaatatgaagaaagcagatgaagggaacttaaaaagtaggaacataagataaagacattgtgtgatatggttattaatgtgttcagaggtccagaacagaaaataaaattttttatacagaaaatagtgacatttttgctgctcttttatttttaaaataaaacccttcaataaaaatggcataaaaatggctttgaaagccaaatatagtttgcctcagggaatcttaagtctttgtggtaagttcaggtttattttaataactcttcctatataatatttgtctttaaacaattataatcatttaaaattagacaaagtttgtgatttaagtcaacattagatagaagttaagagcttgagctttggtatcagtgggaattgggtgagactctttgatcaagcaagtcgtgtgaccttaggcaagctacttgttctctctaaacctcagtgtctatttctaaaatgaggaacattataatagctacctagtggggttgctatgaacagatgaattaattcacagagtgcttggccaagtttacacgtgtacttcctactgtcattatcatcttccttgtcatcaccctcattctcgagaaggtcctggagccctttcctgtgagtggaagtgtggactatccacacttttgtttttgctttgctatataactggacactatggtgcctggactgtaaaactcagtggactaatttttcacttatgaaatgaagaccatattttttttcatgggaaaagaagattttgacatgttaaaactggagaagagagttgcatgtactttgaaagtagaaacagattattagtagaagagatttcttcatagataaacacaggtagatattaacaatattacagttttttgctttgatgaatgatctttgcatattctttttattttttttatataggcaagtttagcttcttaagagtagtatcttagttaacagaacatggtagacatctgataaatatctgttgaataagaggcatttttatttttatataatatgtaaacttaataagtgataattaggcttaaaataaatagccaatatctatttttaattagtaacaattgattatttaaatatcagcccttcttagcagcgagtttactgggatatatttttactaaaattgtcttaaaaaaatctgtttttgcaggtggttatacccagaagccctttccaggccaaaggacttcttttgtcatgcatagaggataaaaatccttgtatattttttgaacctaaaatactttacagggcagcaggtaaagattttctttattttatatttgtgaatatctttatatactttgttttttatagctctaaaagttatatcttttttttctatatggttgatttatattttccttgtagaaagaatcttgatttttttggtatttagtttgtcctcaggtgtaaattttatgtttgggaaaaattcatctagccattttatattttgattgtggaaacaaagaggaaatctgaagtggtagcaacaataaagggactatgtttaaccacatagtaggtgcttagtaaatatggattgaacagaaaagtaaatgagctcattttactaaatagtatatgtttccttttaactaaagtgaccataaaggtcttccttcatttaaatcaggatacctttgactgtgaaggaggtgctgttaacaattatgctgtgctgtcaggtctatgctgggatgactgtgtaaagcaaactaaggtgtttggtcatcctctttttagctcaaaatcctgattttataaacatacatctgtgactgctaatttcttcactgtaatggaaattttaaatagcaaatgatttttttctgtctaaagcattttaatcactcctggaagcttcttcctcactcttcacaatggatccattctccctatgccaaaaacagccactttctgattgccatcagattaggtgtacatgtgtttgggcttcatataaatccatgcacactgcatatgttcttttgtgtttgctttcttttactcaacctaatgcttttgagattcattcatgtttttgcttgtatcagtagtttattcacttttctttgctgagtagtagtccattgtatgaatatctgttgttcatttctattacaataatattacaattttgtacaatattagaacatttctacttagtaaggaacatggtcattatattggatgaatattcattgttcatttctattacaataatatcttacaactgtacaatattagaacattactactaaataatgaacattgtcattacatcatatgaatattcattgttcattgatagtattattactactaagtaataataatttttcttgttattcttatttttctaagtattctagttactaaggaaagtagcttggccctcttcatcaaggtaattttttgtgaatagtattagcatattgcaactatgtttctggagccagcctgccaataaatgcttcttggctgtggggaaaagaacacccaaaaatctgaggcgtgtacagtattgtttaataagtagcatttcattgtatgaatagatcacaattaattcatggcccatgcaactgggcttctgtttcaatgtatccattcctctgtgatgagtttttcaaagtggatgtgtcattttacactttcattggagatttttcagagttcctgttgctcttaagtttaaaaacagattttaaattgactctagatttatatggactctattatagtctgtatcccattatgtaataaaaatgaatgtaagaatttaaaattttgaagtgaataggaaaatatcaatgatatattgtgaatagctttttgatgaaaaggatttctaatactttggatatcctgtggctattatagttataatgccagccagctgttatagccaatcagtaaagaaattttgcagtatttaataaatggcaactgagtaagaaagatttgaaaaagtaatatttactttgctgcaaattttgaaaccagaattggtcaggcaaatacatttacaggattctagctaagagaatgcacttgaaaaatttgtcctaggcttggccctgggagagattatgaaagaccctgatgaggttcagtattcaaaaggtttccagaaatttccccatgcttgatcatgtatcatttcaaggattctaactctgaatcccttcttgactcccaggggctcaatagaggtcacagtgatattggctctttcatagctagaaagcttctctgcagaagaaattaggataggaaaaaagggctaaccaccaaagtcttcatattagtcttctctagatggttgtctaagttgttctctgggccagcagaataatcatcactgctagcttattagaaatgaaaattgtcagtttttatccaagacttgcagcattagaacctctgggagcagagcccagctctctttgtgttagtagccctatagattattctgatccatgctcaagtttgcgaaacactgcctgaggtcagttctgaaacaatagctgatgttgcctgtgtccatttatcttattttattcttagttcttatatagagaggatgcttttgacctatggttttcttagatttgacctctggttcagtatcactatgactatattttggtttctacttttcctttttttttttttttggatcttctgaccctgattctgtaattttctagccctgtgtctcagatgtactttacactggtggtgtaaactccaaacatacagttgtttggaatgatataaaaggaatggtgcattgtgattcagcatttgattgaggaggcctctggaagacattctgtattgaaggaatcaaagagacagttaaaagaaggtgctttacattcatttcaaagaccagagcagcctgacaatttctaagtggtagtatacttgcagtatccataagtaaaaatttaatagattgactttttcccctacatcccttctttttaaatttcttgtgtacatttgggaatagttaaaattgaatggatgaaaacacaaaattgtacatttaaagttttttagaagagttcatattgggactcataatggttcatggatggactaataaatatggatgtagaattattataaatactggctgacatttatataaaaataattgggagttaattgggagctacatttttacataatggtccattaggttaattatgcagtactatcgttcctcagtatactcaggggatttgttccagcccctctaccccaataccaaaatccagagcatactcaagtcccatggctggcctgtggaacgtgcatgtacaaaaagttggccctccatatatgtgcctttcataggccatgaatggtatattttccacccacatttagttgaaaaaaatttgcgtataagtggacccctccagttcaaactgtgttgttcaaaggttaactgtaatcttaaccaaatggaacatagtcaagtataagtaaggatacaaaaagaggtaagtgaatgccaaagctgggctttttccctaaagttatcttccaggtcctggacacattgatcttctgctttgatgattctatagggcactgaggatgggagataaagtacagagctcactttaggtagagactttgctaggagcccttgattaaagcctgtgggaccacatctgcagtgtgaggtgcaaactttggaatagtctaaggtaatatttacaaaatctatgcatttaagaccttgtattttatttatggaatggtatcttaaacacataaatacatttatgaattatgtaattccataaagttagatatgttaagttatgctaatataaggcctcaagtaatatggaaatttatttatctctaatataaatgtctaagttggcagtccagggctagtgtgatagttcctcagtcatcaaggtaccgggcctcttctctctggttactgtgctgtcttcaacatgtagttttcagttcctggtcctaggtagctgcaccagctcccaatgccacatatgtatttcagctaccaggaagggaggaggaggaaaggaaggtattctccttctctttaaagaataacttgaagattgcacacattaaatttcgcttcccacgggtcacatctaatcatatggccatgaccacacctaaccacagaagaggctgagaaagctagtctttggcttaagtgcctaactaaaaatgttattattacacaatgacaggaaatggatattgagggacaactaccagtctctaccacaattacttgcatggtttccaaaagaagctataaattttaaggagggaagagatctgtttgaaataattcagctgtttaccctttgactcatagtccacttctaggaatccattttggagatacattggcaaaaatttgaagaaaatgttactggtcattgcagtgccctttaaacgaacaagaactggaaacaacacatttgcccatcactagaggattttaggttagttgaataagctaagctccatccatctgatgggttacactgcattgtttaaaggaaggagacagatctctttatattgtggtaatagtcagggtttgattggagaccaaaactagaagaagcaaaactgaaagatataagaaatatattctaagcatctgaccatttgcagctgtaaaaactagttaaacagtttaagaaagattgttgcttctgtgtttgatgctataacctgaagtccacggggaagactgtgaggaaaggaagatggaaataaagtaggggggaacaagaacaaaatagaacttgctacagtggattggaacttaggtccatctctcaccacctccaaggcttagtgtaggaaaaacgttggctgctaggagaccgggtaggcggctgtttgaatagcctgtttatatgatatcatggagaaggcctggattagcagaaggaaatgggttagaaatttttttagattatatgaaatatttggtgtctaaatgaatttaaggaggggaaaggagaaggaggtgttaagagtaagtgtagaataagattttcttttctggtattaatggaggaatagtagattagataacctgaaataaatggtgtgtgattgtgtgtgtgctgattttaaatatatactgagctggcatgaaaattagaacgctgcagagttcaaaagcaaagtggagctcagaattctgggaggtaagtgaatgccaaagctggctttttccttatagtcatcttccaggtcctggacacatttaacttttctttgatgattccatgggggcactgaggacaggagataaagtacagagctcactttaggtagagactttgctaggagcccttgattaaagcctgtgggacccattcacagtgtgaggtgcaaaggtggcaggatggaaacttacctgtcttgctctatcctcttggagaagaaaaaaaaaatctcttctgagagtttttatcacaagatgaaccttacacaggattacaatttgagtatgtgctagtagtgcggtctgaaagcacttaagcagataattaaaagtgattctgtgtggatggtgtccatgaaaactgttggaaggaaacaaaatcctctctggagtcacttcaacttaggttagcaacaacccagatactcccacagataaagctccgagtaaaagatagaatccctttgagcggaaacaagaaaaggaagctataaacccatgtagactttaaatattaaaactattttataagaaatgcaaaatgaaggccacgtgtggtagctcatgcctgtgatcctagcactttgggaggctgaggtgggaggatcgcttgagcccaggagtttgagaccagcctgggcaatatggtaaaaccctgtctctacacaaaaaatgcaaaatgtagccaggtgtcatggcatgcgcctgtggtcctagctacttggaaagctgaggtgggaggatcacctgcgcctggggaggctgaggctgcagtgagccatggtggcaccactgcattctagcctggatgacagtgagaccttgtctcaaaaaaaaaaaaaaaaaaaaaaaaaaaaaagcaaaacatgggtttcatattaaaaaaaaggagacacttgagaatacaagaaggtgacaagcaaagttgaagaaaaacaacagaaggtttaaaaagaaaaatataataaaaatctccaatggtttaagcccagaaatttataaacagataacgggggaattgataaactggaagataaaaccaaagcaataaccagaatataatctagagagataaagagaaaggaaagagaggttgaatgtagagggatactgagaaggtctaaatacatctaaggaaacaaacatgagtgtttttcctaataatatttatcagcaaaattttgctgataaaaaagtgattccctggcatatttttgccattttgcctcatcagaactaaaccagtgcagtaggaaatatttcagggaagcatcaactactgcctgcttttccctcctgtagtactatcaaggtagagatgttattttctcaagtctggagtagtagtccatatataatctctaaaataaagtaggtaaaggatactaggtaaagggttccttaggaagctaaaggtaggcatcaacaagttaacttgtcaactttaaaaacaatttacctgtagtgtataattttaatctgtatccatatcatttatattactaaatcctgtttaagaatgattcacttacagaggtaaatgcaaggcttttgcttatggttgctgggcagagctctcactcactggttaacctgggcacctctgggtttcttcttttccttgtagaacatactctttccatgcttactgcccttatcttacccaatgtggttctgaaggggctgacagtcatctcatctgacctgcatgatctcaggacatggccatgtgcctctatctcagccattctgatttcttttctggtattttctacgtggagtcagagtttaactttctatgggtggtttgcctgggatgatgggagactggggctccaaattactcttactcctttaatcttcctttgattagtaagcttctttcacatctctccatttaatctcattttaagtttaacatactttgagtttcagtctcctgtagatgttactaataggtaattttgacgaatacataatcttggctagagaagagatgcctcttttaagatgaaaatatccttcgttaatagcacaataaactgcagctgtcatgatttaacacagatacttcttttgtcttaataggtgaagtaggaaccccctctatttactcataatcatatttcataaggttgctgagaggatttaagtgagattatccatgtgtgtacctgcctagtctttaagtaccattagaacacttatgtgctagacgctgggctatcttgtgtagacatggggactatgtcatttaattctcacaaccagcatatcaggtaaattctgtcattattgccattttatagatgaggaacctaaggattagggaaattagacaacttgcccaaagtcacacaaccaggattgggcatgtttggcacagatggtgacttttaagaaacttgctcaagctcacagaaataatgagcgatggatttaagttttaaaccaagacattttgacaccagaggctgccgtctttctaatactaccctattttgcatcccacctaattattattgaatggaggacataaatgaaatataacttcctccagtgtcctagtttcatgtcaggaaatagctgtctagtttttaaaagtttcccacataattaaaatgatcttattttttattttttcgagacagggtctccctctgttacccaggatggagtgcagttgtgtgatcacagctcatggcatcctcaagctcctgggctcaggtgattctcccatctcagcctttgaagcagctgggaccacaggcatgtgccaccatgccttgctaattttcgtatttctcaatttttttgagtttttgagaaactcaatttttgagtttctccatgttgcccaggctgataaaatgatctactttttaactgaatggaaatatatacagttggcgctttttatctgtgggttccagagccataagtttaaccaaccatagattgaaaatatttgaaaaaataattacactgaacatgtacaggccttttttcttgtcattattctctaaacaatacagtatagcagccatttacatagaatttacattgtattaggcattataagtaatctagatatgattttaaggataagggaggttgtgcataggttctatgcaaatcctgtgccatttagatcagggttctgagcagctatggatttttgtatcttcaagaagtcctgaaccaaacccccatgcataccaagggatgactgcactattcatagccatgacttaaggtagtacatccctatgtagtatatagtccaaggtttgaatatatatatattgcattaatttctccattggcataggattaatttgcttctttgaaagttataaaaactacatgtcacagtctggtctggttacaggtagggggtttgggaacctttgcaccttgtaatcattagtcattaagggacctagtcatatgtccccagatagaggcaaaggcagctgggaaatgtagtcttcctgcatttgggcaagaagagatgaggtcgtttggcccctgtgcagcattgtgccagtcacagttcctgttgatctctctgactccatcatttctgggcctgatctctctgactccatcatttctgggcctgtgctcataaactgctctctgtgcaaacctctgggctgtggtgactctcccacatgtccagcctttagaaatgatttctttcaattcaaccattaactttataaatcgtacagatgaaaataagtcatatattctttatgcagcaattttcttgaattttatttctccttattttgaatatgcaatcaatatatataaaactttaggtttcctgaacatagaaggagaaagtaacctaataatattttcgatttcctgattatttattgtaattatgacatttgagtgcaatgaatctttttagaaatggagaaggatgtttagaaaaggtagataaggcagaaaaatccagctggtgtaaaaaatgtacaaaatagtgatgattcaaaaagagtgagtcagtgtgacattatcacatataggcatcttgtgaagaagatattctttaatgtcttttggttttacttaattgaatgacacatgacatcagtgatattgaattaaatatgattttcatctgtgattcttctagtgggaaatcaagacagactaaaagactaaaatccttgtattgtttgtcttgtttctaggatttctggataatccaaaaatacgtaaaaataggacataatgatattgaggaacttttttagcagatgtactaattgtgtatgaattcatatattttgaagagacgaacattatttaaagtagctttttaatggtagaagacttaaaatattttttgccaagtatcagtgtacgtaaagagagaaattaatattttgtattttacattaagcagattaatttgtgcgggttagtatatttaatgctaggtacactcacaagagtaagttggatccattagtgggagaaattgaattcatttgttagatttttaaattagtttctaaattgaaataatacacataatttaaaaagtcaaatgatagcttctaataaaaaatagcagttccttaccttacccttcaccaaatccaagcatctttccccacaggcaacaactttcaactcttttagttgaaagagttgaactccagactttaagaaatgcattttatttataaatcatccagtcttaggtattctgtcctagcaaaacgaagtggactaagacaattaggtttgctaaatgtcagctggatccttaactacagtgaggtagttctgataccctcttgagtttatttaatttcttctttttaaattaaaaatgtatacaactgctgaaaatcagataattttattttgttgtacacaatattataattaaggcattggtttacaatggcttaccttattttcttaaaaatatttatttttctcattataaaggtaacacatactctgtctgtcagccatcgatgcttaacaggccactcctgaaactcagtggctaagtcaacaatgttctttatatagctcatctgcaggtcagcatttaggccggtcacagctcagcaattctggtcttgtctaggcttcctcataggtctatagtcagttgtaggtcaggtgtgggttggatttgctgattttagttgggctatttcaccagttgtggctgataggctttggtctatctgtccctttatcaccctgcgggctggctcaagcttgttcacctggtggaagcagaggttgtaaggcccttgaagcataggcttggagttgacatactgtcacttctgccatagtatgttggccaaaataagtcacaaagtcagcccaagttgaagaggaggacaaatagacaccatctcttcatgggaaaagatgcctactcatattgcagaagggtgtgaatacagggagatttggattctgtctattgcttaatcttttatatatgtttgtactgaaaagtacaaacaaagataaaaggaactcataagtccatcctctaactactgttgactttttgttttatatactgtaagactgttttatctatacttttaaacgtatattattaatttatttcagtttccatttgattacaagtcatgtttgtttatttcatatttcttctatgaagtggtcaagtagatttctattttgttcttaaaatcgcatggtagcatttcttgtaaatctacagttccagatatctaaagccggcaggacttcagctaataggcaattattctattttgtgatgagaaggccctgacttagtattgagtagcaggaagaatcaaaaggtgttcagtcaactgacagtgcaattgcctttgaatttgtttgtatatcttctgtgactgagttaataaactgaactattcatggaataggacccagtgggattttcttatgctatggtatatttttaatattattcacttttcaggctaagtttgaccgtaagcagatatctatttttgatcattagctttaaggtatttacattctcaatgactaagcttaagctatgtggtagagtgatttatttttgttcctgaataaaattttaataccatgagtcatgtgttttctttgtaaaaagttccagcatcacagaactatatagcataatatagtgaaagttcccttttcctactggctcactttgaactcctttccttaagcctttttctgtgcttttatatttacatacatatgtgaatatatagaatacatttacttccatgtaaacagattttgtgtgtgtaacataaaaatattgtattataaacattgttttgtaacttgctttgcaaattattttctatccatttagtcaagtatgtgagtgtataaaatgtacacacacaaataatacaaataagagcatgttacaaatattgtataacttgctttttttaccaatatatttttgatatatttctgtatctattcacataggcttagctggtttttatattcataaaaccgtattcattttatagtcataaaatttcttcacatgtaccttcacatgtatcctttccctattatggaacaacgaattgtttctaaattctggttattttaaaaaatgttgaagaaaacatctctgcttgtatatatatgtgtatgtagaagaagaaaattacgcttgtgttctttattgtaaatattctacaacctgtatctcttaatccctttcttgctttctctaagccccatatattcaatttagccctgagtaatgcatgattgacgaagccagatgctgtgtgtctaaacagcagttaatgaaaaactatggaaggatagggaatcattaccacaggtactgtggggcggcaagactcaataaagtaactgttactaaaatctaaaaatgaaaacaggaaatatttgtcagacatttaacttggcaattgtaagagtgaaaaccttgtgtttttattcacttgtgtatcagaatttgccgttttttaattaagagttattttttaagagcaattttagattcacagcaaaattgagagatagacatggagattttccacatacccactgacctcaaacaagcatagccttccccattgccaacatccccatcagagttgtacattttttacaattgatgacctatgttaacacattgtcatcactcaaagtccatggtttacatcagtgttcactcttagtgttgtaccttctgtgggttgtatgatgacatgtatctaccactataatatcttgcagagtatttccactgtcctagaaattttctgtgcttcatctgtttgtctcccctcacttcaacccctggcaaacactgatagctttattgtatccatagttttatcttttccagaatgtcatataattggaattatgcagtatgaaaccttttcagattggcttccttcacttagtactatgtatttaagattcctccatgtcttttcatggcttgataactcatttctatttaatgctgaataatactccattgtttggaagtaacacagtttatttattcattcacctgcagaaaggtatcttggttgcttctaagttttgacagttatgaataaagttgctgtaaacatccatgtgcaggttttggtgtgcaaataagtttcaacttattcatctggtagtaattgttttataaatttgggagctccagtgttagatgcatattatttaggattgtgatattttcctgttggagtagtccttttatcattatgtaatatccccctttgactttttaaattgttgttgctttaaagtctgttttgtctgagaatacctactcctgctagctttggtttccatttgcatgaaatatctttctccatccctttaccttaagtttatgtgagtccttaggtgttaagtgagtctcttgaagacagacagtagatacttggttggtagatttttatttattctgtatctcttaagtggagcgtttaagccatatacatttaacattagcattgagatgtgaggtactgttttattcatcatgttgttgcctgaataccttttttttaaagttgtctttttttaataggccttgtgagatttatactttatagggaggttctattttggtatatttcaaggttttgtttcaagatttagaactccttttagaagttcttgtagtgctagcttggtagtggagaattctttcagcatttgtttatctgaaaaagactttatctctcctctatttatgaaggttagttttgcggcatacaaaattcttggctgataattattttatttaaggaggctaaagataggaccctaatccctcttggcttgtagggtttctgctgagaaatctgctgttaatctgagaggttttcctttataggttacctgatgcttttgcctcacaactctgaagattctttcctttgtcttgactttagataacttgatgaccacgtgcctaggagatgatctttttgcaataaatttcccaggtgttctttgagctttttgtatttgaatgtctagatctctagcaaggacagggaagtttttctctattatcccctctaataagttttctgaactttcagatttttcttcttcctcaggaacaccaattattcttaggtttggtcgtttaacataatcccaaatttcttggaggctttgttcatttttctttgtctttcggttaatttgtaagccttgtctttgagctctgaagttctttcttctacttgttatagtctattgttgaaactttgcagtgtattttttatttctcttagtgtgtctttcatttccagaacttgtgactgttttttctttatgatatttatttctctgtataccttttcatccatatcctgcactgtttttttttaaattttctttaagttgtttttctaccttttctggtacctccttgagtaccttaataatcaaccttctgaattccttatctggcaatcagggatttttttcttcgtttgaatctattgttggagagcgagtgtgatcttttgggggtgttacagaaccttgttttgccatattaccataattgcttttctggttccttctcattttggtagtgtttcagtggaaagaactggaactcaagggctgctgttcagattcttttgtcctgtgggctgatcccttgatgtgatgttctccccttcacctggagatgggacttcctgagagagctggactgcagttcttgttattgtctttcttgctttagccactcagcggggctgctgggctctgggctgatgctggggaatgtctgcaaagagtcctgtgaggtgatatgtcttcatatctcctagctgtggatgccagcacctgctccagtataggtggcaagggagttaagtgtactctatgatagtccttggttgtcgttttgtttagtgtgctggttttttcgaatgctggttatgccagcagtgaagttgttatgtggacagacttagaacctctggttagtcaggatgttgtagatggtagaattagctgttttctccttttttggagcagggttattctgttatgtcttgagttggttggcctctacccaggaggtggtgcttttaaaagagtgccagctgtggtagtagaagggggatacaagtttgttctttgttggccaggatgagtacttgggttcttcaggcaatggatggggctttagagttctcaagggtttatgtattttggctcaggctaccagggtgggtagtgaaaaaccatgaggtgggggcaggcctaggcaggtctgagctcagactctccttgagcagggcttgccgaggccactgtgggtgatgttccggggcattacagctgcctctgctgtgtcatactggtcgccagggaaggggggaaagccggcagtgacaggcctcacctagcttccacgcagccagcaaggccaatctcactcctgccatgccccaccaacagcacacgtttatattcaggcagctggggagagcggatagatcttgccccagactacaagccttcctgctgagaaaacaagcagggctctcaggccttgcccttttccgtctgcctgcaccatcagctgtggcttctgtgcttgtatctgcaagttatatgtgcacttcccatttgccccctggactctgctcaggaaaatttgtactcagttgaacgtattatgaagttcagctagaagcttctttcatcctatggcccctccctaattccactggctgccttccccaaggacccctgtgagataagtcagggatggctttctctggtttgagccgggaactgggagtgcctacagggcgcttcccgctccttcttctactttgatatttcacttggctgcctaaatccattttaacttcagatgagattaaattcttctcctgtgatctggatttttaggttccccagtggggatgtctgttcagaggcagacttttcccccactcacactttgggaacttacagtttttcagctgtctcatggagtttgcagtgtcaagctacttctttcaaagtaagtagcctgtgaattcttttggttttcctggtaggttcctgtggtggttcttggaggaaaagtttacagtgtgagtctccacacactgttctgtctgtccaaatgggagctacatgttagtcctgtcttgtatctaccattttctccatgttggtaatttagatctttgtatttcctctagcttttaaaattttagtagtataaaattttctttgcagtatcatttgattaaatgtgttaatacatgtatttggaatcatgcctgacacatagtaaatgcttaatacattttaatggtgttattaaaagttgttgctattattatcatataaaaatctcctatgatttattttaatattaacacttaaacctaagcttttatttagaatgttgggggcatgagaactaattagaagaagtattctaactcagtagagagggtaggggtaagggtctgtaaaacattagcaagtggggtcagctgatatttagccagtttcagagttagtctaaaactaccaacagagtaaacaggcaacctatagaaggggagaaaatatttgcaaactatgcatctaacaaaggtctaatatacagaatctgaggaacttgaacaaacttacaacccaaaaacaaccccaagcaaaaaagtgggcaaaggacatgaacagacacttttcagaagaaagacaatcatgtagccaacaagcatacgagaaaatgctcaacatcacccatcattagagaaatgcaaatcaaaaccacagtgagataccatctcacaccagtcagaatagctattattaaaaagtcagaaattaagagatgctggtgaagttgtggagaaaagggaacatttatacactgctggtggaaatgtcaactggtttagccattgtggaaagcagttttgtgttttctcaaagaacttaaaaaagaattaccattcaacccagcaatcccattattgaatatatgcccaaaggaatatgagtcattctaccataaagacacatgcacgtttatgttcactgcagcactattcacaatagcaaagacgtaaaatcaacctaaatgcccatcaatgatagactgggtaaagaaaatgtagtatatatacaccatggaaaactctacaggcataaaaaagaatgagatatgtcctttgcaggacatatctggaggccattatccatagcaaaacattatccactatagctggaggccattatccttagcaaactaacacatgaacacaaaaccaaataccacatgttctcacttataagtggaaggtaaacattgagtacacacagaaaagagaacaacagacactggggatctacctgagggtggagggtggaaggagggtgaggatcagaataatacctatcactgaggttggtggatcgcttgagccaagggtttgagaccagcctgggcaacatggtgagacccccgtctctacaaaaaaaatacaaaatttagccaggtgtggtggtgtactcccatagtgccagattcttgcgaggttgagatgggaagatcactcgagcctgggaggtggaggttgcaagtgagccgagattgcaccactgcactccagcctgggcgatagggtgacaccctgtcttaaaaaaccctccaaaaccccaaaacccaaaaaacaaactaccaatcgcttactatgcttattacctgggtgatgaaataatttgtataccaagcccccctgacatgcaatttacctatatggcaaacctgcacatgtacccttgaacataaaataaaaataaaaataaaaaaaggttttctgaaaagagaggaattgtttttgcagtttagtagccattgatggggtggttcagatttagcaagagaggtggatagaaacagttgctgggtctgtggtcatatgagggccactgtggtacatttttagtctttctgagactcttacagattatttagaattatttacaacatattctaacatatttgggagtgtattttatcattttaaatcaagccataatcttccactttttgactacaggccattcctaatgtgtttctcagaatgtgtgcaaagtcaaatatctggaagtcaaatatttacttacatttaataaatagatttctttaccaagagagctaaaataaaattctatttaaacttcaccttttatacacggttgtcagtaatatagtttccaacattttatatatacctttaatttttttctttttgaattgatcagttcaagtgacttaaatgcactgagcatccagctgaggttaaaaatttactgtgtgcaacatagcaaataatttctcacttgacccttacttattctctttggtgataagagtgttttcacttttctgttttttacttataaagtattaagggcaaataagaattctaataatatagaaacattgctatacaggcagtgacattaacaatgcccaaactgaacacttgactagcagaaagggtgttgagcttccattcttacagctagcttatcttcagaatttcaaatttagaataaaaggcatataataagccctttaggagttttcatctacactatatatataactgtgtgttgagcataagttgaaaatatgaaaatttaggtctgcccatacttagaggcagataggtagaaaacactaaactcttaaggccattaggtatttagtaatttttatgtacagttactttttaaagctagaaataaagttgtaggcttataaaaattacagttgagaaaattttctcagtaatatatattttagaacatttattaattttattaataccctttcagcatctctcagtgttgaacttgaatttatgaattctagctaatttatatatctttagcactgaatatagctagggtatgaagtgattaatattggactacaaataatagtttctggctatgtaaataaacttggagttcttcattttttgtagtattaatgcatgatttaatatgaaggaatttatgttcaagaaaaatacagatttctaatggaggagtgatatatagtaatgcactgaggcagatggtggatgataagtatgtatagatcacacctgctttatggaatgtaaagcttgattcgtgtgtaaaaaattaatttgagaaaatggtagggaatggctgggagtctgtgagagaattctagatttaacactttgattagtctcaggaaaaacagccattatataatcttaggttatattttctatttttaaacaaatatggcaagcataacacctccctttttaaaatacacagtttttgcaatttttcaagacttagggaaaggatcaagcttgatatatgtttatatttaatacttctgaaacccattttgggcagatttctatctactataacagtggttatgagcttggaccgctgagtggccacactatctataaccgagttctttaatatgtctttgcctgttttctcatctgtagcattgggataaatctagtagcagtcacattgagttgtaaggataaaaggtgatactttaaaggtgcttaaacgtgcctaatatgttgaaagggctcactaaatattagcttttctcattattgttaatatattggagttttatttcataaaaggtgaccttttcatctaagtgctatttataatttaaatctctgttaggtctttgttagttgtctgtcatcctcacacttgcccttctgtgttttcttctgtaattcatgggttggaagcaagtaaactgtattttcctcacccctttgctagctgagtttcattagagggtgggaggaaggtagaaaggacgccactgaggtttttgaggcacctttggtagtggcagttgaggagacttcgctgtgttgcagtgaccgttgttccacagtgtagatggcagcgatgttggtggcagggcatttaatagggatgggtctgctcagcagcagccaatggtggttccagcactgatagtggctcctgtgggctgttgggtccagctcagagatggtagcagcttcctgatccctggtttgcattgtttaaccatttgttactctagcccttccaaagtctttgtaacagattccctgaattaaattaaatttttctggagaggttgccctcgagaagagggtgctcatcaataaaatcaacagttgtcatttaatgttagatatgcaataaggaattttgcagtctaataaatatagcatgtattccccgtatatctttcttacctgaaaataattgtgttttgtcagtgtgtcccagtgactttttctgtctcctctgcatttaggaagtcagtggacacagctagtgcttggtgtctagggggaattgttgctcctcatgggtaatattggatttatgaaaactgagggacttacattaccaaaagcatgatgtgaaaaatatattaaatatatactaatatttcaatgatttaaagtcatctacccaatagaagccactatatttcattgattctaagctaccccttccccccctcatgttttaatatctctggtattggattgtgacttaaaaacagtagcatgttgcagtcatctcatccagtggccagtagttgctgttatctgcttatgtgccaatataaaaatcataatacagcttagaataaaattccagagacaccagagaaggtgtctcttttgacaagttgaagactcttttgacaaggagatgctaaatggttgtggtgaggtagaagggtggggaagtgggaaatcacagtagtttaacaacccttggaagcaggagtctaaagtaggctgtgcctaattactgagctagcttgagagcttagcatcaatctttcaattttttaatgaattcatttaaaaaagtgctgcatcactgatgtgcttggtgacacagaaaatgagattctctggagaaatgtggacactgatatatgtcaaagagtgagggagaagaattacatttggatttcttcatgaattttaggaattgattaaaccaacttattttgcttatgttttgtttttatgtctgtgtcagtgtgatagataataaaaacccatatctaattaagtcttttttctttcaataagaataaaataaaagttctaaaaagtgtatcagtttaattagcagttttttttctaatggttcatacaataatgatgccctttattgaaatatttttttctatctctgtataattctttttgttaggtaatattttttcccttttaaactctatgtgctgatgtagaatggctttaaaatatcgcccttttattcagtgttcaattttttttttgcgccagttttccaatttaccttgtaaaattgacaccctatgaacaaagtttattctatatgtgtagctccttgctatagaaaatgcattggaaaatatttaccaaaggaattcaaatatattaaacatgaaagacaaacaattgccagtaaaactggtgataggagaacttttgctacactattaaatgctgcataccagagagtacagtatacaaacaaacaaaaaaccctaagggtaattgcaaagattgaacaagttgtgttataaatgtggccaaattttaatgtgttgtgtgttaaatatactgatgcatattatggaatatcagtctcatcaaagcttctttttttgtttacattaaatgagacagggaaatgtaatgaagttaatttggaaattttataagaaatatgaaggtgccttatcatatcattacttttgtgatttatatttgccaacttttttttttttttgaaatggagtcttgctctgttgcccaggctggagtgcagtggtgtgatctcagctcactgcaacctccatctcccaggttcaagtgattcttatgcctcagtctcccgagtagctgggattacaggcacgtgccaccatgcctggctaatttttttctatttttagtagatattggatttcaccatattgcccaggctggtctcgaactcctgaccccaaggtgatctgcccatctcggtctccaaaagtgctgggattacagacatgacccactgcacccagcaaatatttggcaactattttgaaaagattcctaatttatctcattatgcaaaagaactggaaatgtgagacttaccagttaattaattattgaagaaaaaaattagactgcatttgagtttaagtgggtccaagactttctgtttcaagttaatattgctgttcatttaaaaataacaggtgatttttttttaattttcagtgttactcagtgataataagaaaacattatcctctgaaacaataacagtataaaacatttacgaccttaaaatcatgttttatatgtacaagtatctcagtttaagaagtctcctggccaggcgtgatggctcacgcctgtaatcccagcactttgggaggccgaggctgacgaatcacctgaggtcaggagttcaaggccagcctggccaacatggcaaaaccctgtatctactaaaaaataaaaaaactagctgggtgtggtggcgggcacctgtaatcccagctactcaggaggctgagacaggagaattgcatgaacccaggaggtggagattgcagtgagccgggactgtgccactgcactctagcctgggcaacagagcgagactctgtctcaaaaaaaaaaaaaaaaaaagtctcctggttacatgaaagatattagctgattatgacttgatatatttagactgttgattggtcattggttttcatttagtggtcaagagtgtctagcaaaatgctgactggcatatgcagacactgaatttacatcttcacatattcatgtctctcaatattcagaactcagttaaatttatccaggaagataaggaggtcataaatagaataccaaatgtggttttgcttcttttacagttagagagctttgttaatatcctcattttcttcatttgtactagcatttccaaacagaatttgtttcacaaggaagtatcaatgtatagtgtctctgtcaggccttgcattaagcccagtttctcatagtcggttttcaatgacatttctaatttggtatactttctgttatatcacaacttattttcccagccatctaagggagacttgttaaggtgggtcaacctcatttttgtttttgattttaatattaaaaattttgttaaaatttttatttcgaaatagttcaaacaaaaagattgcaaaaatagtatgaagaattcatatgtacctttcactcagcattcccccatgttaacctcatacataaccacggtaatattgatcaataccaggacattagcatggatacaatactattaactgctctgttcacttaattccaatttcgttaattgccccactaatgtcctttctttggactgagattctatccagagtctatttatcgttctttctccttagtttcctttattctggggaagacagttcctttgtcttttttgtctgtcatggtcgccacatttggtcagctcttttgtagactgctcctcaaattggatttgtctgatgtttcctcatgattaaactcaagttatgtctttttggcaagaatattatagaagtgatacaagtgacagagtgtccatttcagtgcatcatatgagatgatgtttacttgtttttactcttctgttatgaatatgtaccccactgctaagaatgccagcttttagcctttgtgcagctaattatatttatttttcaagatttgcctttttaaaatggttttctttatttgctgcacttcatttgatctctcacttctttgccttccttttgccataatactcagtaaaaccttgtcatgcttatggcttgaaagtctatattgtgttgtgggagcctcacccactgttgctcccaggagtcctctctggtttattcccttgggacactgagacttattataccaatttattttgtccaaacatgctctcaataatcactgtgggttaagtactaccaaaggttggcacttaattattattttatttattgaaagttaattttatcttctaattagatggtatcttcttgccagcgtggacaattctacagattttttttttgattacttggagacagaaacaaatatttttaatagtatcttgatttagtctttctaatatagactgttaatctttagatttttcgataatttaaggtgaagggggaggaaaagattgggtacaactgtgtttagggaataatttaaaagtgattactagaagaaagtgcacttagttttcttgttcatatattctttcttatctctagcatcagtgctaaaagtaacagttggtatagaagtgaaaattgtcaaaaaaagactgattaataacctcaaagctgaaaggagattactaattcagaaaatgacagttgtaatatagaaatccaatattagtttatagttgattatcagttttatacagaaaataatagtgaaaagaataactctttttttagccttaatgactctgtcattgaattacttcaaattgtgatgatattttcttcctaagagctgattaatttaatgtgttcacactttgttccaataatggtcctaagattacaggtggaatactgggacacaaaaataacacaatattttgtcagagatgaccaaactcattagatacagagacaaagccagaattgggtttctggttgggtagatttacgcccctcctacctttccccattagactgaattttaacaaaccagacaggctttctcaggtatggagacttcaaatatgctgctgtaatcagacagcatgagctaacatattttaggaatatacttgacttcattttaaatagagaacatttatgttttctcactatttcatgtgtaatgcaatatgaataaagccctatccgagtttcatgtttgtggggaaactagcattactgcagattagtgacagggcagagaaatgaccttattatctctgtaatggtaatagtgtgcttcacagggaaacttgtgttgttaagagtgagttgttattttgttgcagatgctttctgcacaagttattaatatattgaatcagaaggattggaaagtgctatctagggacttaggaatataatttataagtttcagtattcacctttacttgaaatatgtaaatctgattttgtagatgtatacacaagcataaacatggtttcacgcttgtgtataccttttctttctttatggaatatactctctatttttcttgtgtcaagtacctctgtctctaagacccacagcagttgtatcctccgtgatgaaacctatccctgtaaccgagttgttgcttccctttagattcccagagcaatttgttcccattgctatattatgattttatttgttggcttataaatctatttccatctttgtaactcacagttgagcgtgtgcttctcaatggcaattcagtttttcaattcatattccagcatcttgcatgatgcctgcatatattgagtatgcagcaactattcaatgaaaaatgtatattaaacttggtatatatatatattatttacacacctcacctcttccaaaaatgtgtttaagatggattataagctatatagcaaattagaagaaaactgggagaaaaaaggaggaggatgggaaatagaatggggccaaggatgagcaaattcacagcatgaatctctaagtgaatgtgtagtatgaatgagtgcttttgcatgtacacggaagtgtatatgtggaaacttacaatatacattaaaaaaatctatcctgtttgatatttgcatttttacaattttggccttgaaaagatttcttatttttctgagttgttcattttgtcactatttatctgatgctgaagtgtttctctgaggaatgcttattagtcctaagattctaatgtaatcagcgtgtggtgaaatagagcggtgtcagttagtcccacttctgtgaaaataggaatctgtaatatgactctgtgtggtgctctttagcttctgaagattcgtgctctaactcctgtcacctgctctcttctagaaagcacatagccgtggggtaggaatgcaacaaagctaacttggaataataaccttttcctggaataaatatgttttaaattaaatttaactaagaagtatctatgaattctagcttctctcaggtgacttgtttgccaaatttaaataaatggacatattaaaattaattcttattctcctgttctcaggataatgtttaagcaaatctaagaggaggtttttttttcttattgtaagtatggtgtttttaaaatagagaataaaactttgtttgctttgttattccttagttaattgttaaaataatgaggccttattatttggggtaatttatttaagacaatagagcaattaattgctcattggcaacctgacaaaggaaatgggccaagatgccaacccatttcttgtggtctgccagcccttagaattgtgtgttccagggatttgctaatcaccagctggtaactgatttacaaggctggaaagacaggaggactcttgaatcatggccacttacaagtaagatggaatgtgtactggctttaagccttgtctactggcattcagatgttgctgccaggggaaagacttgatgatggcaaagagcctgtgtgctatctttggtgcatttttccgatgtcatcagcattgttcttgaccctcactttggtttaacaattaagacctgctaagtagaatatactacttcagtgatatgtgtgtgcctctctgtctatttgtccacccgcccgtccattgatctatccatctgttcatccatccatccatccatccatccatccatccatccatccgtctatgcatctatccatgcaatgaatactggggttaagccatcaatgaatgggctagaattaacctctgaaagcattgtttacaattggggctggcaatctttttctgtaaacgaacagatggtaaatattttaggtttgcagaccatactgtctttgttggaactagtcagttctgctgttgtagggtagaaacagccgtagacactgtgtaaatcaatggcatggttgtgagccaacgaaatgctgtttacaaaaaaatcaacttgcagctatagttagcccacccctcatttagacagtggaagtatccgactcaacatagtttgggagctacacaaaaacttttaaagaagtgtatgaatgcttataagttttctaacactgctttatgttccaggtttgttagcttaattattgtctattttgggatttatctaaaaaagtagttttatagattttactgttttttatttaaacatattaatcatttaaatgatattaagctctcactgacactgattatataaatgtcattggattggaaatctacaaaaaaacaaggaataaaattcaccactctatcacccataaagcacccattacatttaatagtttttacttataaacatgattttaaaaactactttgacatggaaatatggtcaagtatattgatgagtgaaaaaaatgcagattgtagaagagttctgaacagtgtgtacaatgtgattctatttgtgaaaagaaaaaatattatatatgcgtacactaacatacggtaaatatctgaatagatatggaatcagttcttagttttcaagcaaatgaaatcaactctccaatataagcggaagaaatttattgaaggataataaattactcacagatttctggagtccttgagaatcaggtttagaggccatatatctagaagcaataccccaaataactggttctgcaaagaggccctggcaactgtcagtctgaatccttgatactactaagcctagatgccggatttgcctccactgttagcagtattccagaatgaattctagacagttactgctcttctgtgtcatcagcttccaattcagagtctgctgtgggtgcattggattgccagagcccaagttttgtgccctggctgcagaggaaccttagcggggaagaatgtggaactcacttctgtagtggacaaagggccctgcctcctaaggtaggggatttaccaaatgtaggaagaggattcagaatcttggatgccagaaagagtgagagccgtccacagcagactcctgggaaattgttaacattggttacttctggacggtggagttggaagggctaactgggagccttccagagggaggcttttactttaattttattcttctgtcctttttgaatatacatatataataaaaaagtccatggggaaaatgaacaaaagggaacaacagttttttccagcatttccactgatagtattttcgcataagaactcaagaatggctaggcgcgatggctcacgcctgtaatcccagcactttgggagcctcggggggcagatcacctgaggttaggagttcaagatcagcctggacaacatgttgaaaccctgtttctattaaaattacaaaaattagcagagcgtggtggtgcgtgcctgtaatcccagctacttgagagtctgaaaatcacttgaacccaggaggcagaggttgcagtgagctataagattgtgccactccactccagcctgggcgacagagtgagactctgtctcaaaaaaaaaaaaaaaaaaaaaaaaaaggccgggcacatgcctgtaatcccagcattttgggaggccaaggtgggtggatcatttgaggtcaggagttcaagaccagcctggccaacatggtgaaaccccatctctactaaaaatacaaaatttagcctggcagtagtggtgtgcacctgtaatcccagctacttgggaggctgaggcaggagaatcacttgagcctgggaggcagaggttgcagatcacaccactgcactccagcctgggtgacagagtgagaccctgtctcaaaaaaaaaaaaaaaaaaaaaaaaaagaactaaagaaggcttctcagcataactgggcagttttatcaacttcgtactcaattttattttgaaattcagtttataattttctcccagattcagtcatctctatataacttggttgggcagagaagttcataaaatggttttctctcagataccagtggcttccttttggcttggtagagctgatttagtttatctttttgaggtctacagtattcagctttgaaaagtaaggtgttgtcagtgactctgattgatgaagtgttcatagatctaaggtgaaaaaatacaatctactttaaaatttttggccctactattttttccaaacccccataaatttgctactttctagaaaattgatctgagaacttaattcagtttaataaagttttatcacatgtaataacaatttttaagaacaattttagatttacagaaaaagtatgaacatagtacaaagttcttagataccacacacagggtttgccttattaacatcttacatacatgtaggatacaattattatagttaataaaccaatattgatacattcttattgactaatgttccttctttattacgatttctttagtttctaaagtttatttttttgttccaagatagctgatatgttttatacatttatattgcatttattcatctgtgcagtaatgtcatggagccatatcataaatgctatttctgttttaagtaatacagaatttagagaaacaaaaaataaaataaagctttgctacagtgagcttcttaaattattttatgcacaagtgtcacctcagaaaaaatgtccttttttttttttcctgttctgtatttagcggaagaagtccctatagaaccatacaacatcccactgtcccaggccgaagtcatacaggaagggagtgatgttactctagttgcctggggcactcaggtgagtagcattgatcccaactgttaaaacctacgttgtgcttggaagctctcattttaaatcctgatacatgaaaaattgaaaacgatgttttctttatatctcagattaagtctggtgctactgatgctaatttcttttttccctcaactttattggtgtgtaattgacaaatgaaattatatatcttcaaggtatatatgtgatgatttgatatatgcatacattgtgaaatgattgccataatcaaattaattaatggatccatcaccacacatagttactattttgtgtgtgggggtgggggcgaggacacttcagatctattattttccctagtcactgctgtatattagatcctgagaacttcctcatcttataactgaaagtctgtggtacggatttctgagtgaaggtgaggtgtctatatatattaaaatgtatatgcatgtggtggccataaatatattacaacaatgtattaattagaaacacatatcttttggaatacatgtatacccatgttactttcgctgcaaatggctataatctttttcatcacatttcctgccatctctcatcattactttgctgctcacgtggacccatccactggtcaagcctcaaaattccatatcttcctttttttccagtgaccctctctgctgatccacttcattttccccccgacttgctgtcactttgctctacctcccaactttttctctggccacgaactcctatctcttctacttttctctctccttcttttacagatatggtcagttttaatttttctgtataaaggaaatccttattttaggaaatttagggcaatgcaatataaagaagataacaaaaatagttttcaatatcacaagctcctactctcctttccttttgatttttggcatggagagctagagtccttatggtttctcaccttcagtggggtaactctgctgcttggcgagttgtatcccattgatattgtccttggtgggtgtggcaaacctttttgctatccttctgtccactttttgatccacatctctgtggtcagctcatgaccttacttctctttttaatagggaggttagagtgtattaggtattaattcagataacttgctcttcctcttgcttctaattctttccttcttccctttgtcttgaagaagaggtgtctggtttacttagcaacctctgcaaatcagtttcagactgcgttccattttaccttctccaggactgtagtctattagctagtccatctctctcctgcatcttcagttttccatttcttgttgctcttatttaaaaagtatgtttctcttcactatttaaagattcctttctccttaaatacgattatgtctccctccttttaacactgaacttgaacaactgttttctagtgtctgtatttaatttcttaaattcattatatttttgtagctgtgagttctattcccactaatttactgtttttgtcaacattactgatcttctagttgtttaaattcagctcttattcctgctatggtatgtgatactggctgctatccctatgaaatcttttcctcttaagtttctgcaatacactgtctcctggttttctttctagctctttaaccgttctttttatctcctttttttctttccttccctccatttttccctccctccctccctctctttcttccttcctctcctcttggtccattttttccttaaatgttggtgatttttaccctttacttctccctctacatgctttctacgtatttgtatgacttcatttaccttctacatgccatctttgtaatcagtatctgtggtactgacttctctctctaagcacctctttccatctgttttctagacatctatacttgttattttcgcagaatatgggcttcaacatatttaaaacaaatttataaattctccatgcagatcagttcctgagactttaaatactgtctctaatagtgacatcagcattcaactagtttttgaggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccctgaaacctttggccaaatatgttgtatatttgcaaataattcttttgaaattgtgagctatgtgagcattttcaattgatttaaaacttttaaatttgcagcatgaaagaaagttgtataaacagcttcatgctcaaggaaacaaatcactatagaatttatttttcctcctgtagtttcctttgtttaaaatattacaaaatggggtcctttatgcagtcaccttgggttgaattgtgtgagtcatagagcatatcaaggatgccgaaggcacctgtgtttttgacttcttattagttatggttcagtaagctaggtttaatttagtcaggtaaattaagtgatttggctgaattttcatttatcttctctccaaaagtaatggggatggattttttaaaaacataactctgtatatagtcttaatactgtggattacagtctaagggttatgtggagattctggctcctctaatttacagtttctatctaagtagcctcatgacctttggcctgattacattggtcttgtttttactattaagatttacatagccagttccctcttaagaatatagtttagctctcatttacctctttatatccagtatctttcacaccaatgccaagataatttaagaagcatctattttcatattgatacaaagaaggttaagcactctgtttgtaatagtcttatcaattaagtctagctacatgtaaattatatgtacctagtcttaatagataagtacaatagatatatgtacgattaatagatagatgtacaattacatgtaaaattgtaggaaacaatgacatgtattattttttcttgatatactgctatagtatagggcattttatatttaccacttttaagagctttggcattttcatagcttttacaggctctttcttgggttagttacatgaaaataacctgcagatactactgtaaaagtatagcctaggatgtttttaggtgaagagtgttttataatttagtagaagatgtaagatttgttatagtaaatgtttgtgaagactcacttgacaccatctaaacacttgacatgcttacaaatgatcccgagccattctatttgtagttgctgtaattaagagcaatatttcagattgagttattcatagcttcatgaaaataacgctttttgcaggcattttcaaatcaagtcagacaccgggttttctttcaaatagccagacgttccaaattatagttaaactagagttgtcttcttgtttgcaacatatatccaccacttatcctggggtttgtatttttagtgtagatggtgcttttgtatggggatatgatgttttatgatggcgcagtgcggagggcattcacatatggtcagggcaagcacttttagaactttatttacgtatctatctatatatatataaataataccttaaacattcaaaaagcatttgtagcagcttattgtaaagcacaagtatactaatacttcattttggcaaccgtggaagcaaagagagtagagttaggggcagaaagaagggtgaagttgtttatatttacatcgatagcagtttgcttttgcatcactgtgttaaatctgttggtcgcatctttgtctgatcctagaatgcagatccattttccttagggctctatcctactgggaaagatgaaagaggagacaagcgatctctactgaatgagaaagtgatgcatcagacctctgacttattagcgtcattattttgttttgttttgggatgctttcatccggttgtgacagtgaaagccagcttcttgattgctttgggtctatttgagactctcttcgttgctgatgatggtacctctcctgttttcttttgatgtatcaaaagaggtaaaattttgatacttagctttttcctgctaggatttagagatgattttaaagaagagggccctataaccaaatatttatatggaaaatgagggttttttttcccccagagtgaagcttttttaattcatcttgatgaattctatagtaaccaaaatttatattataatctcttttaattagctgtgttttatcagttgtttttgtcttatgactcattagatcgctgagttttattcgttgtgtgtcaactaaaccccaatatatatcttttggaacgcctgatcaagaaaagaaagcatattaaaggcaaaaacgattcgttgaacacacattatcatactctatacactaaaatgcctctgggacacttgaggaattcatacttcttgcttaatccttgatacatggtttggaagttataaaccaaaataaatatttgctcggggatagagaaaggagcagagtctttgactgttgctcaagggagttaaaaaattagagacttaaatggtcctagaaaccacagctagtttttccactcaattctgaacttgatattaaaaagctaagctggagacttctgaaaagcacagtagaaaattcttgagttttgaagtgcttaagagacagagacctaccctgtgccatgggtgtgtgtgtgtgtgtgtgtgtgtgtgtgtgtgtgtgtgtgtgtaggtggattggcttaagagaatcagctgtgtgagttcaaagccctgaaatgagtggcatgttgacaccgatgacctatagctgctttttagttggctacacttgctatttggtctcaaccaggtgtgtagaatccaggtatatagaactcatattttgtggggctgtagtgacaaaattgaaattttgaggggatttaaacacatacttgaccttttatttgccaaattctaaaggtgtgaatggtgaaaggtaagtagaaaatatctggaaagtgaagctatcacttggtaatgaagtgacaaagacccatcatactctcaattgaaagccatggagagttaggtcttacaattagaggcaaaccagatgtagaccaggtcatctcaaacccacaatacagcctctacccctttgaattttttattgaattatgtacttttactctatctgcgcagcagagccaaggagtcaatcctctcattatctggaacttctataaaccagcattcaataaaaaactaagtagatgaagagacaggagtatttgatcaataacaaaggggaaagaaacaataaaaagcagaagcacagctgatccagatattggagttagcagacaagaacatcttgattgttatgcttaggaacatagagaaaataaggaacaaaagaggtaagagggtggagaattaccctagaaagtttgtgtgtgtgtgtgtgtgtgtgtgtgtacatgtatgtatatggatcaagtaaactttgtggagccatcaaaaaaatatatatctgacagtaagaactcaatgaataggcttataacatatcggactcagtagatgatagcaataatgaactggaaggctagttaatagaaaatgtccaaattgaagcacaagtcagaaaagaggataaaacacatttgggatctggtcaaaagatctgtcttatatacaatttgaattccagaaaaagaagagagagaaaatctctaacagtatctaaaaaaaaattctcatgaagatttcagaacatcattacacaagctttgttaacttttaagattatattcaaagaaaaccacacctgtatgcacaatggcataacatcttaaattgctgactgtgctagcctacaattctatattcagtgaaaatatcttttaaaaattaagatgaaataaaaatagtttaggcaaacagatattgagagaatttatcactagcaggctctcactaaaagaaggtactgcaagggagctccctttggcagaaggaaaatgattctaaaagaaaatatggaggagagcatacactatagcttagtattgattatccgaaacagtagtcataattttctgtgaaagtttaagtttagtgaagtttaagttaaatatatggaattgaaatgtaagacaataaaaacacaaaagctagggggtcttacatggagttaaaatattctgttgttctaggattattatgaagtgtaatgttctggttaggttataatcaaggatacaagttataatctccagtgtaacaactgaaataacagggaatgaatgcatatctagcaagttaataagagaactataaattaataaaaatatttggttaatccaaaataaataagtatgaaaaatggatgggtcaatagataacagatgataagatgatataaacccaaatatagaagtaattaaattaaatacaaaaagattaaataaacctagtaaaagtctaagatcctcagacttcatgaaaaacaactaccaccaccatgtgtagcttaaaaaaggcatactttaaatataaggacatcaaaatgttgaaaatgaaaggatggaaaaagaaagctggtgtagatacactaatttcaaataaagcattaaggcaaaaaggactactagaagtgaaaaggagcatttcattatgccaaagggaccagtccaccttaaatatatcataatcctaagtctatttcatccttaataacatagtttgaaaataaataaagccataaactaaacaaagaaaacacagaactcagaagaggtatgaacatattcacagttacagcaggagactttaagacatccctcttaaatcttgcttaatcaagcagacaaaatctcgtgaagtgtatagaagatctgaacaaagcaatttgtaaagttgtcctaattgtgcaccaaactatcaatagaatatgtagcatttgtcaaaattggccaaatgctggggcataaatataaccttaaaaaattccaaaagcttggagtcattgagattatgttctctaacaatagtggaattcagttagaaatcaagtgaaagaaaaggacaactagaaaagcctcgacttcctacaaattaagtaccttactctaaataaccgtggattacagaagaaactcaaaaattagaaaagaaactggactgaatgttaatgaagatagaatatatcaaaagtttcaagaaccagcttaagccatgctcagaggaaactttatagctgtaaatatataaatttaggaaataggaataagaattaaaaaaattaatgatctgaatttccatctccagaaagaaaatcaaacctagagaaagtagaagaaatgaagtaattaagagcagaaattactgaaattgaatctgtagagaaatttaataaagtaaaatttagatctttgaagagattaatgtaattgataaacttttaactaatggaaaaaatagggtagaaacaaaggacaaatatttgtttgtatgatgaagagcccacagacaatggtaagacaaagaggatgttatgaataattttacaaataagttttgagtaaagttgacaattttctggaaaaatataagtcattcaacattgatacaagaggaattagaaaatctgaatagtcatgatctattaaaaaattaaatttaatgttattaactctcatacagagaaaaccccaggcctaaatggctttattggtgaattctctaaaatatagtccttatgcaaacccttacggagagtggaatcaaagagaaaactttcaaattctttttataaggccagcataatcttaatatcaaacgtatttaggacagtataagaaaggaaaattatagacagcttttaaaataaatgtagagcacataatgttcataaatattcacaaagcagttgatacaattcctcatgttaacagaaaacaggaagaaaaacctgactaccttggtagtgcaagagaagtatttattaaaattcaatatttattcatgattaaaatttcatagcaacctagaaatggaagataattatcttactctggtgaagattagttgcaaaatgcctgcagcaaaaattataattcctagtgaaattttgacagctttcctcttgatattaggactgtctagggaaaaatttcgtgatacgtatgtcagaactttacacagaaaatcacagaatattatttaggaaaattaaaggcccataaactgaagcatatagcatgttagtggattgtaaggccaagaagagccagagcaatcttgaagaagaacaaaactggaggacttaattatcaaatgttgagatgtgttattagtgctgtagtaattataacattatataggtataaaaatacacaaatagaccaatggaataaaataagagtctagaaacagacctgctggttatctgattcaggacaaaggtgactttgcaattttgagaggaagaggtagttttctcaatagaggatgttgattcatttgggtactatgaaaaataattatattaactcttaccacacaagcatcagttacagctgagttgcagatctaattgtgaaaggaaaaaataatgctcttgggagaaagcataggtgaatatgttcatgtgatcttgtgcactaataaaacactaacgttaaaaaagggctgataacattgtgcttcattacatttaagaaaatttattcatcaaaagggtgccaataagagagtaaacaggtaattacagatttggagaaactcaaggaaacttatatctggaaatataaagtacttacacaatcaaaaagaaaagaccaatatccaatagaaatatgggtaacagtcttgaaaaggtacactaagtgttggcaataatgtggagcaattcaactctcatagactattgttggtaacataaatttgtacaaccattttggaaaattgtttggcagtatctacctgaaccctataacctagcaattccaatcctgtatgtgtatatgtgaagaaatatacaaaaaaaaaaaaaaaaaaaccagaagcgttcataggaacattacttctagtagccccacactgtaaactgccgaagtactcatcaactagagaatggatcaataataagtataatattgttcagtgatgagaataaatgaactaaaaatgtaatggaataatgtatattcatctcataaacacaaagaagccagactcaagtaagtacatactgaatgatttattttatatagaggtaaaaaatagacaaaactaattgatgatgttagaagtcaggctagtgattatcatgagagtggttaataattggaagagtgtgtaagggctatgagttgctggtaacagtttcttgttctgagtgctgattattcaggttaaatttttgaaaactgagccgaacactcatttggtgcaccttttttgtatatatgttaaacttgaacaaaatttttaaaaaagaaataaaaagaagcactatcttctgtttaattcatttcctttacttcacattgtagtgagcccttttatggactcagggagagagagccttggtgtccttagccaggaagattttccttttatcatgcagctctgtccacacccttcgttcagtttctccctgcaactcagctcagctgtcatgctgatgtgaaacaggagctcataagtagggctgttctctctcaagccttcccaggagtaagaacagtggttagggttatgggctttaatggactttcctgctgacatgcagaccacattcaaaatgagttaaaaagtgagctgccgtgttaacaaaacagtggccaggccgaatagctgttgaggtgctgtcaagcttgaaaggaagatttttcttaaataaggagaaattcagagaaggtgccttcaaaaataagaacttgattttggcaggagaataaacaaaaggctttgaaagaaactcagattctcaagcatcgttgtcatttaatctagaatcaactacataacaacactgcaaaaaaagaactgaagcacaatcatttacaaggtctaggtgattttcacatatctatagagaagaaaaaactgacacttataattctgacatgtttaaactttacctgaagattaaattatgctaattattaaaatgtataagaatttgcctttataccgtacagtctttttaatttatctttttctggtgtgtcctgcctcccagattaaattccaaagcatatcctgctggctttgcctacataatatgtccaaaatctgaccactgcttgatcctgctgcagactactagcatttctctcctgggttttggccatagccacctaacaactgtcttgcgcttctgacctttccttgccataggcagagttgatacttttaatctgagtcatatcatgttccttctagtttcaaaaagcctcagtgatttcccattgagagagaagtcaaattccttaccatggcctacaagaatttacctgatttcatcgctttccacctcctaccacccatccaccctttagaaaatgttctttctccagcaagccccttcattcactctgttattctatcaggggaacctgcccccaacatttcaacatagattctttctattttccataagtgttggctggctgagaaataaagagaaagagtacaaagagaggacttttacagctgggccaccgggggtgacatcacatatcagtaggactgtgatgcccacctgagcctcaaatcagcaagttttttatttattaagggcttcaaaaggggagggggtgtaaaacagggagtagatacaaagatcacatgcttcaaaaggcaaaaagcagaactactaataagggtctaacaaagagcacatgcttctgagggaacaggacaaagggaaaaagcagaaccactgacaagggtccaacaaagatcacaaggcaaagggcaaaagcagaactactgataagggtctatgttcagcagtgcacctgttgtcttgataagcatcttaaacaacagaaaacggggttcaagagcagagaaccggtctgaccacaaatttaccagggcggagtttttccccaccctgataagcctgagggtactgcaggagaccagggcgtatctcagtccttatctcaactgcataagacagacattcccagagtggctgttttagaccttcccccaggaatgcattcctttcccagggtattaatattaatattccttaaaagaatttagcgatatctctcctacttgcatgtccatttataggctctctgcaagaagaaaaatgtggctctttttgcccgaccccgcaggtggtcagaccttatggttgtcttcccttgttccctaaaaatcactgttattctgttccttttcaggtgccctgatttcatattgttcaaacacacatgttttacaatcaatttatacagttaacataattatcagagtggtcctgaggtgacatatatcctcagtttacgaagataacaggattaagagattaaagtaaagacaggtgtaagaaattataaaagtattatttgggaactgataaatgtccatgaaatcttcacaatttatgttcctgtgccacagctccagctggcccctccattcgggttccctgacttcctgcaacatcattctgttaggcactactcaaataccattaaggccttccttgaccagcttatgtgatactgaatcctatcaagacttcctttcaccttttccttctttcctcttctctgtagtgattagcatgagctaaaatgttacgtactcttgttatttacattgttgatctttcttccaagttctgtgacagcagaaatttttgtcttttggttcaaaaattcccagtacctgcaacaatgactgtgataggattggtgctcaataaatacttgctgaaaagtaataaatattagcaagagaaagtttaacaatgctatgaaaactgttgtaatattaaaatgttttcaatttggtgcttcttcttggtgctcataaaaaagtttaaaaagtaactttagaacagtattctatgaataaatacattagtttattctaaattgaaatatttatttaaaagttttaagttttgctttgaccttgcatttgacttttcttaatggttgtctatgtttcataatggcatatagaaattatttatttgaattcttattagaataggaacaatttatctactttgaaaggcaaagtgaaattgactgtacagtaaacttcagttattcttaatttctaagacatgagttttatggataattacattttctgaatagatgggagttactatttgtatagcagcttttaaaactgggtctgtcctgaatttcgtagccatcacagccactgtgcactgctttagatgagggttcttctctgttcaaatacaccctgttacaagatactgtctcccagtcttccctccccctcactctctgcccaaagcaatctcctacctttttgaagttcttgggaagtgtttttttttgtttttttttttttaattttaacaaaattagaaaatgatagagaaaatatcttcatttctgttccctccatttttctctccagctctttttcctgctttccctttcttttctcttttaaacataggttatgtagtagaagatgaagacatactcatagaaatgaatagttgttctttgggtacatattgggcatctctagtctcaagatattttaggggtagtctatcataggagcaggataaggccttaggggaaaggagctagaagtaattcagctgtggcatgagggagtgacagtagctgggagggagggctcagtgttcttagatttagcattctttcctcccatcctttcaccccaattatttccattcttgctatagaagacttcactgggggaactggataatagcaggacaggcactaaggctggcagagttagtgggaatggagacgatcagggagcagaggtcttcagcaaaaaaggaaagggaaattgtagagctggaatggggaaggagtcaaaccttagtaattggatgaaggaccaagtttgtttactctttgcatttgcacctgggtgttaatcaccaagtatttgtgaatggtgcagaagatgttctgaagacccatagattaaattggaaatttaattctgatttgttagactgaatagctttaaactggttttatggagaagttgaagaatttgtctatagagaatctctaatatttaagtattgccagttaaaatatacattttaaaaattggttacttgaacttaagtgaataattccgtgactgaatactagctattttgtttgaggctgtgtctgtttgaggggagcagagggggacagaaagtgagttaatgaaatcaagaacattctcaaacagttgaggggttgggatggaaagggagctagtaactacctataaccactagaggcctctcttaggccaagtttcatggttaataccactaggtttccacagcggggcctggctctgccattgtaaattaaacatatgttataattctgaataaatagtatgacagtagttttattctagggcattattataatgtaacctaaatggtttagcttatatatcagaataactgatgatctcgtgaattgaaaacaacaaattagaattattttctctcttctttttctctaaacctttagttaaaaatgtaatcaaagactattgctaggtaaaattatatgtcttcttgaccgtacaaggatatatgggtttaaaattattcttgttacatgttgtgtttaattgttgagagtagtttatatttctgagggtagactataataaagtcattttaagtcatatgttaaaaattatgtgtatttctttcatgcttataataagcctctaatataaaaaaaaactaagaaatgattcaaagatctgttagacttaaatgcttttccttaggcatagggaaaaatggtctcattttgtgtgagtttggaattattttggatatggtttgaccttgcagagaaaacaggtagggcggtgccctcctctcagatgagaatagtttgtttctctgttccaaaacaggatggctgacaatttgaaagttggtccctcctgccaagtcattcttcctgtaggattttctttgtcatgatcacaactagttagttgttgtactaattggaacaagttctaggctgttggatgctatattgggatgtggctactacattgattgtcctgcctgacagcccttggccacttcctttaagtcccatgagggcagggaattttgtgtattatgttcattgctatatctgcaagagtcctgaagagtttagaatatagtagatgctcagtaaatatttgttgaaccatctgaaaaataacgtggcatttggtttttcagtgaaagaaattaaagaactggtaaatcctctaggaagaaaatacactgagattatcagtcatgccatggggtctatttttattatgatttacattttaggtacattttaaagaagattaaaataataactatgggttctgacctaatgttatatatatatactttttgtttttttgagacggagtctcgccgtgccaccagtctggagtgcagtggcacgatctccacactgcaatctccgcctctggggttcaagccattctcctgcctcagcctcctgagtagctggaactacaggcgtgcaccaccatgcccgtctaattttttgtattttagtacagacagggtttcaccatgttggccaggatggtcttgatctcctgacctcgtgatccgcctacctcggcctcccaaagtgctgggattacagacgtgagccaccgtgcccggccaatgtatcttacataataggacttagttcctggtaaatggtaaattaaaaaagttaaaactacatatgttatgcatgtttccttttgtattcaaacagttcttctaattagacatcagtgtcattattttatagggaagaaaactgaggtttggggaaggtggagcagcttacagccagtgggggacagcactggcttcaacccaggttgctggataataaaaattgtcacttgagagttttgctgatcaaatgcttctaaatgtcagcttagaacatattttatcatatgtcaggaattttctttcacatttgcccacctttataatataaagatatgtgttttacaggtgggcaaatgtgacctgtatacaccttgtaaatcacactaccatattttctttcatttagcattttttttccttccacatggaactggagaaagcaagattaaattatataattatattgttccatttcacatcccacctgatgtgtttttggtgtcctcttatacacttaaattatttgagtttgactcaagttttcattttgtttaaactgtttgctttcactgttacgaatagcagtgaaaagaaagaaatccgttacctcatttcataatgaaaaaagattataggtacattatgttcttagtttaacattttaggtgtaatacaagaaatctaaatgtgttgactttctgttctttctttgatggcgtttaactctctcccattaaactggtgctttttttacgaaattgtatttattctgtaatcgttaagaatttcttatcttttctattataacaccctggctttgcagtgctgagcagtgataatttaacttaaaaatttattgaaactgtgatgtacaaaggtttaacaaaaggatattacttttctagtttattccaaaactggggccagctatggtggctcactcctgtaatcctagcactgagcctgaggcgggtggatcacttgaggtcaggagtttgagaccagcctgaccaacatggtgaaaccccacctctactaaaaatacaaaaattgctgggcatggtggctggcacctataatcccagctactcgggaggctggggcagagaaactcttgaacccgggaggcagaggttgcagtgagccgagactgtgccattgtactccagcctgggcagcaagagtgaaattccatctcaaaaagaaaaaagaaaaaaacaaaacaaaactggggctactcttaccagccatgaatagtcaatctttccaaacacgtactttctgtgctttcatttttttcttctaggaacttggtttgtttctttacgtgtttatattttcttttatgtgtttaattaagttatatagtttcttacataactatttcacatctcaagtttatcttttaatattctatatttggcattgtgatcatatcattacagttttttctgtatttccctttcctttttcttttttgaatgtggcagaagagatttaaaaattcaagcaatccattaacatagcactaaaacacacagtacaatggagcttataatgcaaagtatcatcttccttccctgcccctactccctaaacacagccacttttaaccatttctgtattttattcttctgaaggccacttccatatctctagcaatacattgcacagatatttctgctataatggagtatatacatttctgcagagtaaattggattctccatgcatgctcactaaaaataacagggtttatggaaagaaaaagtgcgtgtagcaaaccacttaaaacagcttggtaactagagcgaagaagggtttttaaccagagtcaggaaggattgagcctgttgatttatggagttcagggcaaatgcatcaaagttggggagaaagatgtaataaacacttctaaatcagagcagatgggccagcctgagccaagagacatagtgcatggtactatatttctctgaggcttgagtcagcgctgtggctctgctttgcgttttgctttgttcctaagtggcataaaacaatgtgctggggcagattgtacatatgccaacacgactaggttggttgccgccacttctcactggaaacacatttcatacttgtgccaggaaaatggacttttccttgctcagtccattccctcatgtgtttcactgctgagttaggttttgtcggtggagcctgggtcacatctttatcttggctataatggaggctggaaaacatagtttttttatattctaccttgggaaagtggaattcataattaggagaactatcaaaatgtggagaatatgttaaaaagttttagatttttcaggaatcagaagcctaccacacgcacatgcactcatgcacacacatgcatataggtgtatacacgcacacgtatgtgtgtgtttcaatgtctgtaacttttgatttataaattttaacataatttattcaccactatgacacataacagtttagtgggcttgcattccctgctgtcttcatctcatatttcctcagttttgagttatgatattacctgtattttattttttctactgattacctctttattgtaatttattttaatttctatatcttactccattaactttgcttagaatcttttgacctctcactatgtaagaagatgatgttaatgccctctactcctatatccactgttctttcctcccttccaattcccattttctgtcagctgattatttttacattgccaagactgagaacattacattgttttataaccgaaatgaaataattaaacccttgattttaaaagttgaaaagcagtacacactgttaatattattatgataacaaatatttttcaccactgttgggggtaagattttatttttcacttgaggtccagtgcttggtctttgggaccctaaaaggagattctcttggcatctagatcaaatggtttgccttttaaattagtgcattaactgttcaatgtcttgccacattctgaatgtttcatatttgggctgtggcattcttttagatccttttggattttttagttttaattacctttcattttctctttgaaaaatcaagacaagcctttaaaatatcttgaagatcactcatattcttttttggaatttactctttttttttttttctttttttggagacagggtcttgctcttgtcacgcaggctggagtgcatggtgtgatctcagctcactgcaacctctgcctcctgggttcaagctattctcctgcctcagactcccaagtagctgggattgcaggcatgcaccacgatgcaccactaattttgtattttttagtagagacgggatttcaccatgttggtcagtctggtctcaaactcctgacttcgggtgatccacacacctcggcctcccaaagtgctggaattacaggcataagccaccgcacccagggtactcttagttctctaatttccttttccagtcttgactacccttctctatacctgctgcacaacaatcaccagggatgtttctccacttcactcttaaaggcaccatttcctgggtcctgcgatttgctcttccatggttatctttctcattttgttggagtacattcataattaactttttaaagcaaagggcatattgggtgcaggaggttttctgacacttgtgttaggtaaaatgtttttatttggactcaacatttgcttgatatttggctgcgtatagtattctaggttcacagtaacttttacttaggactttgaagataatgcttcattatatactagtgtcacattggggtagaaaattttgatgccaccctgattcttattcttttatacatgatctctctgtgtgtttgtttttctggaagcttttgtgattttttgatacattttatactgaaatattacaggtgtgaatctaaatatgagtctgtttgactcatcttgttttgcctctcatgactttcctctgggaatggcctacatatttaaggataattatattctttcttttttttgtatattttcttttcaaaaaactcttagcagttgtatgatagacctgctaggttgattctgtttctcatttcttctctcctagtttttgtcctgttgtgtttttacagtgttttgcatatttcctttattgtatcatttaattttttttgaatatttcaatctcatcaatcaaaatttcccccttgtactcagttatttttgtatcatgctatttgtttttttttttttttttgtcatgtattttccttcagttgttacgggtatatacatttttttcaagttatgttctatagattatctctgtttctttagtagtgttttttttttttttttttggtcatagttcttttcttcatttgtgattgttgattattctggatacctgactggtgcagctttcctttatgtctctttcttctctaggcttttccactatggaaaaagttgcatagatctgtgcacatggatgagacattgctttagggtaaatgaatgagaagttcatccttaggcagaaggggttgccactaggttagcaaatgggatactcttgattcttggacatcagtgctcataggataagcctgtctttgtaggcaatttgaatgctttttatcagagactagctctttttcttttctttttctttttttttttttttttgagatggagttttgctcttgtcactcaggctggagtgcagtggcaaaatctctactcactgcaatctccacctcttgggttcaagcaattctcctgcctcagcctcccaagtagctgggattacaggtgcccacgaccatgcctggctactttttgtatttttagtagagacagggtttcaccatgttggtcaggatggtctctaactcctcaccttgtgatctacctgccttggcctcccaaagtgctgggattacaggtgtgagccaccgcacctggctatttgcctgattatctctggcatcatgctttttatttgggttttatttgggggaagtggagcaattgatacaactgtgttatttaattctgttgtttttattctcaattcttatactcacctctctacctgctcatgagctcatcttctctctgggagattagctgtttcttccactgtacctccatttatctccgcattggcttcctctactctttgtttatattttcatcacacacccacaaaagacttgttcagtctctcttgtctaataatcactaccccttcccgactttgttgtttttgctgttacaggtttttccttttgtattcatgtcctgtcttgagagaaaagggacatgaaagcgtatactcagtctgtcatcttgaactggaaagttttctctattgcattttcttattttttaataggcagcataatttgtgtatcttagtctgtgtactgtcatttcaccaaaatcttatttattctaatagtttctttattggttttctgagattttctaggtgggtaatcatattctgtaagtaaaacctattttcatctcttcttttctaatctatattcttattttttctcatttgtctagaacgactgaatgatgatgaatgaaaaaaatgatagcagacattaaatgtgatatttataaggcccaatttgaacttattgaattattaagtagaaaattgaaagtatcaacttcattgtatagatttctggcttactgagaaatgtatcagcaattttctgcataattagtgtttttgagtaaaagaatttggcacttacagccaaataccgagtatcttatatgtttctttttccaatagccacaattcagaattgggcttcctaaaacagtgtatccttccaatggcgtttcctaattttattattattttttaaaacgttttattttattttagattcagggggtacacatgcgtgtttgttacctgggtacattgtgtactgttagggattgggcttctagtgtatgtacccattacccaaatactgaacattgtacccagtgggtaatttttcaaccctttccccactctcaggctccctcctttcggagtccccagtgtctattatttccatctttgtgtctgtgtgtacctattgtttagctcctacttataagtcagaacatccagtatttgattttctgttactgagttagttcacttaaaagtttacctaattttatatgacaaagctggcaaatcactgttgggcaacatgattaatgttattgcaataagtcagttaaaaacaagtcatttaattggcagctatgaatcttcaactctaaagccaataaagatccagtgaaacaacgattactagaaagatacctgcatttgaaaaatatgcccctcctgattgacagctaaagaaagactcattgcaaaaacagactcattgctttttcctctgtcccttctttccctggatggatctaagatctgataagtctttcaacactgagtttacaggtttttttcttcatggagctgttcctgatctttttttcccattgtcttttaagtctgccttggagttgtcttcttagtgttcccgtggcattttccatccatctgtttcagagtagatatcccttagtgttgtaatttttaatatccttatctatttctctctaagagattgggtttcttggaatctcagttttttaggatgtggctaagaatcgtgaagtaggtagaagacttctaagcagcttgaggtgctaccataaacccatgtataaaagcacatacatttagtctataagagtggctactaggcccttaatcatatcccatcaactgttactttacatagaattctaacaaactttttacttagtttcttagcccacattagattggaagcaacacattagaagatggggaaaagttatgttgatgaaggtagggatgttggcaagatctaaagatgatatattgatagcctgaaaataagataactgatgggaaaagaaaaatctgttaaaagtacaaaagaatatagttttaaaaatcacagccattcatattcatttaatatagaaacaaggtaaacatctaccttgatagcatagtattataattgatgttccaaattatatctatcattgtgaagagattaatttctgttctatatgctgtgtttgaaatacaatattattgcttaaggtatgagtggggtgaactctcaaatgtgttgaataactcagccccctacagtgctagataaatgagttcttgttggtttctttctaaaagctgcagggtactggtgctttgcttctaatcattaattttcctttggttacattcacattaataataatgtcattaagtcatcttctgttagggcatttttctataaatttctaatttcttatgtcagttttggaaaataataaaatgacccctttctcttggctcttactattttttctttaattattttaatcatggaactacttatgaatttttctggtagaagccttagtataccattaattctgatactattttgcattaactctttgtgatattttctagacattgctttagctggattggtgggcaggaaaaaaggaggcgattaatcctccatttctgtagattgagattttgaggtgtgacagatacgatatgtagtaacagtactgcaaatccctgtgctggggcttgaaactattaatcttgttgtgaatcatatgagacatgtttcgtatgtctctccgtgtggttaaactcttccaggggagcttgggctggtggtgccaaagggtggagggggattgactaatctgttaaatagccttttatctgtgagtctagtttctcattagtatttctgaccagaagaatagatggttggaaatgtggacttttgtttttaattagtccctctagggatgagaggcttatttggaagaatggaattttaaggaagcctgacaacctcagtttccatgtgattgaaaatgtttggcagctgaaaaatgtttcacaattatgagttagagccagattttccactggctaagctgttctttgggagttagatacagggtaactcatatttccactttcaggtctcagtggctccgtttagggtgctgttcatgggactctaatgctccttccttcccaatggcccagaaggctcccatgaggtttattcttctatcatgtataataaactgatgaaataaccatatttcatctcatatttatgcattttaatcaggttggttgatgtttaccacagacatatgtctacaagcatttcattatctataaaagagagatttttttctttccttttttttttaaaacaaggtctcactgtgttgcacaggccgcagtacaatggcacaatctcagctcactgcaacctctgcctcccaggctcaagtgatcccccgacttcagccttctgagtagctggtactataggtgcacaccaccacacccagctaattttgtatttttcttttgtagagacgggctttcgccatgttgcctaggctggtcttgaactcctgagctcaagcaatctgcccacctcagcctcccaagttaagtgctgggattacaggagtgagccactgtgccagacccccaaaaagatattttcttcctcttttatactaccataaaattataatgctactgtattgccacagttttacaactgagtcagttttgcccaagatcctttgatctagccaaagttttgaagtagccaaaagtgcacagactttggaagccacgcagttcatctccctgtgcacttcaaggtgacaccctgacagatggttgctgagcacccactggatttttcccataaagtgaggcaaccagttcttttgttgtgcggttctagttgttacagttttccattgttgaactgaaatttgcctttctctaacttccacctattgattcttattcttccctcttgtatgtaacttgcctttgaatattcgaagacagcctcctcatagtcctcttatatctaggttaagcattccatccgttcctttcaggtgttatttaaatctcctggtttgcagatgcaccactattctgactaccattttttggacatagtctttatctctgatggcctttaacttaaaatggcattaaaatggtcctttagatatggcttgagtagctgaatgcctagtagagctgttttcctagaaggagatatatactttctatacttctgttttggaatacctgaaaagatagtttcttggcattggatatgttaagcagatgcacatatgttagggatgttgtagacaaaaagtgaataaaaagtatgttgggagggtggtgtccttacaagaataaatttaaatggctgttaatttttaacagcactattatgaaatatcaactataaaatatagggcatattacagtatataatgttggtaataatgtctgagtgaatattcttttcttagaaggtcacttaggtgcttttgttttttgaacaattcctgaataaacttgttagagtactttgtatctgtgaaagattgcatcccttgtcaaaaactttcaatttcacaaaaattccatcaacattttcccttcacagcaacatgatagtgctttaattttctcaatgtttggccacattgttaacttatttttttccccacttttcttcattctgctccttcctttgaggcagtgtttacttgttctttatagagttaacatttggtgcaatacaactagattgttagaaacttttaaaaaccctactcagtattgttattagcattgttttgtccattaccaaccattcacctgtttcctttcctaggataatgttaactgtgctttattagatgctctcagatatttaccaatgacatttttgtaaatggaatattgtttactcttaatcctaaagtttactcttaatccttaatcctttggaatgtctgttgaccttactgtaaatttaaggctgtataactgatagatttcagcaaattatggcagtgagagttttgatggtatctattttatgtcaagtaattcttcagtgactatgttaacatttcactgcattgtgtagagtcttattttgtttttccatgaggtaatttttaaaactacagggctattgagagatatttagtccagtaatacattccatataggggcattcaacgagaagattcttgtgttacaaggaaaggatgttaaaaaaccagaatctctcagtaaattgtggtctgtaacaattccatccctggggaagggcggcgcattgaaacttccatgactattaatcttgagagagagcatgcattgtcttgttggactgaagcctctagccatcttatcaagccagagctacaaaagtaggataactttgcatccctttttggcccactggtgaaaatgaaaatggtaggagtggatggacaatagattaggttctttgacaagtaagtgttgagtgacagtcatgaatatttcccatttcttgattttaccaattgtgtctctaaattcactcaccagaaatatacaataagaagctgaattttcttggattacttaacttgttttagtgaatgggtgagaaaggtttccagctgtagctgtcaggtttttttctgcagcaggcgcctgccttcagcgtttttgaggataacacgatacactctttcttcttttgctaccattaagcatattatgctgccttttgtaggcaggccaccaggctataagtcggactccgtagtctggttatgagctctgaggcatggagagggatctctggccctggcttttctactggttgctggatgaccttgggcaagtgagtcaacctcttctttatcttctttccactttgtaaaactgagactttctttttttctctagtcttaaaaaaaagtttgcaaccattaaatataaagggtaaacaagagtttcttgagtaagttaacacctctctggatactttagttaatatagataggattacttcttggattactacagtaaattaaacaaaatactctacatgcatttaacatgtattacagattgtctatattaaataaaagatgtaagtcgtgtctaatttgtagaagttatttcagtttcttttggaggaaagcaatgtagttatttatgttgtccctgtaagttgtattacagcattagagaacttctggggacactgaagaattgtttagtcacttacacccttaaactccctttagggagtccagttgattcatgtggaccctccaaattatctcgtttcccaaattttaaaattgcattgggattatttcatctctttagggcttttttacttttcaatttaattttgctatgttttaaaaaaactagtggatgaattatgctcactctgaaaagtatttgggttccagtttacataaatttaattccagttttgtgtcccagaagtatgctatgtctttaaaattcagttagctcattaacactccagttctcatatttgagtgccctataaatctgtatacttgagtaacctgagctgcaatctgaagttaataatacaatctgttcttaggtatgtgaccgtaaaattccttaaagggagtcctgtgtttatgaatctgaaagtgttgagcttgaggtaacagtggggctaacatcttatgtgagggtttaaaaattataataatctactaatggtagagatgttttctaataagagtaattctgtgactcattttagttcccttgctttttattcctgtgagccatagaaagaacccactgtagggggttagaaatattttttcttatgattgtgggatgaaagagtggttgctttttccaaccaccatatgtggtgattaggcttttcagaatgacattggggtacacactgagcatacagcaacagtcttccaaataacttataataaataaagtatgtaagacgtttcccccagccagatgtaatcttcaatagtagaggaataaatttaaagtgacttcccacaggaaaatttgggaaatgcctggatggaccaagaaggcagtcatgctgttagaaataagcaaactcctttcctcctttcaggtgagaatatatgatggttcatttaaattttgtttttgtgatttctgggatttcttagaaaatgcatggataaaaccaaaaaactccagtgaactaaaagtctatttgaactgtttgaaccttgctttgcatttttgcttccaatattcaaaaacatttaagcagatggtactcagataagtgtggggacatctccctgagtgtgtagtaacagatctaatttttgtaaattgaattgtactttacatctaatagagacagcaccagttcctggggattcttgaaaggtggcaatctaaatcacctttattttctgagcttcctctcaggtgcctaaaacagcagcttcagaatttctgtgaggatgaatgtgggtgttgaagtgggagatagctagagaacttgtcttgaaatggcattttgtttttcacagacagtgctttgagatgggttttatgtttatttaggtgggcttggggtggggggttttgtgatagccagcctttggtgcttgtactactctcaaaccatacccgagccacatgtgcaggcatgtgtgtagagacttgaggtgtactgacccaacttgtcgccagcctgggctctcagaaggtttcagaagtttgttcttctctctgctcgatgggagttaaaaagtatagcagtggagagatccagtgtgagggcctggacttccaaccttccagggagagctgggcttgggagactaagaactcctcaggtatgcctgaacatgcccagtagtctatagcaaggactggccactgaaacacaacagaagacatcctgccaaactagcatctcctgaaggcattctcgttaaaactgtgtattccttccattgtttttttcatttaacagatactcagtgagcaccttctgggaccatgtgttctagaaatggagaacaaagtaaacagagtagaaaatattttgccctcttggagcttagacactattgcaggaggcaatcagtaaacagatatactaatacatatttaagtcagatcccaataaattttatgaagaaaaatgaagcagcttacagaaatagcagagtgaagggaagggctatgatagatggttagatgatagttgtcactgaccactgctctcaggtggtgccttttgagcagacacttggtatctgagaagaagagttggcagcatgatagcatgtgcaaaaggcctgaggcaggaatatgtttgtcctattggaggaacagcaataagcttggtgtggttgtagtcgggtaagcaaagattgtaagagatgaagtcatgaaagtaaccagtggaacaaaatagggatgtccattcttatcattagtaatcaacattatgctggagagtctaaataattagactagaaaattgaagagttgttattaaaaaaaaagaaaaagtaaaattatttgtattttagtgaacatgagtttatgcttttgaaatctagaagactttcactaaataatttagaatcaatgaaataattgagagaagaagcttgaaatacaatgactgtttataaaatctataggttttcctcatattattagtaagaaatagccagaaatggaaaatgacaaagatatcctatttataattgaaactataaaatactttagaataaattttacaagaaagaaagacagtggatacataaagaaaagaataaaatcttaggaaggctgttaaaatcagactaaaatatactgtgttcttaggtattcttaaacagtagcacataacaccatttaatacaaccccaatttgaattccaaaggggtttttaggttgttttttttttttttttttttttttttttgagacggagtctcactctttcgcccaagctggactgcagtggcgctatcccggctcactgcaagctccgcctcttgggttcatgccattctcctgcctcagcctcccgagtagctgggattacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcctggccaggtttttttaaactacctaaaaatatttaaaactatatataaaaaatacatgccccaaatagccaagaaaaaaacagtgaagaagattttctattgcctgaaattaaaatttactgcagtgccatgtaaacaagctatggctgggatttgacatatggaacagggggttagcaattttttttctataaagagccagatagtaaatattttcaactttgtgggctatatggtctgtcttaattattcaactctgcccttaaagcagtgttttagtccattttgtgttgctgtagcagaatgccactgactgggtagtttacaaagcatgagatttatttcttacggttctggaggctaggatgtctaaggttgaggtgcctgcatctggcaaggaccttcttgctgtgccatgatgaaggaaaagagagcacgtgcaagagagagaaggaagggggccaaattcctcctttttcaagaacccactcgtgataaagtcattctgtagtgacatgagggctctgtcatgagagcttcattcatgagggctttgtctaataacctcttaacagtcccaccaaacactattgcactgagaattaagtttccaacacatgaactccagaggacacattcaaaccaatgcaagcgcagaagcagttgtaaataataaataaatcagtggatgtgactggatctcttcattgccagtggttggccaattcatgatgtagatcttaaaacaaaatagtgctcagaaatagataatatatggcaagagtgctatttcaagtcacttgggaaggatagtttactgaataaatggtgctgacagtttatgtaaattctacttaattatacatacttaatgtatgatgctttaaatataaaaaccaaatagtaaaacaatagaaaaaaatttaagagaatattgttataacctagtgttgaagcaaagtttttaaacaaggcagaaaatatagaagctataaagaaagtatagatatttggctacataaaaaaggaatgttattatgtattataaacatttataaacaaaaataaacaaaaataaaaatggtattctgtgaaaaatatttgcaacacatataacagaaaaagggctattttctttacatccagtgtgcctctagaaatgacctagtaaaaacagggcaaagaacagtttctgaaaagaaaagccaagtgggcaatgactgtaggaaaagatgctcagtatcatagaagctgtaaccttttgtaaaatgggatagtaatagtacccacctcttagtgctgttggaaggattaaatcaaatcatacaaataaagtataagaaagtggttggggccaggcgcagtggcttatgcctgtaatcccaacactttgggaggccgaagcaggcggattatgaggtcaggagtttgagaccagcctgaccaacatggtgaaaccccgtctctactaaagatacaaaaattagccgggcctggtggcacgcacctgtagtcccagctacttgggaggctgaggcaggagaattgcttgaacccagcgggcagaggttgcaatgagccgagattgcgccactgcactccagccagggtcacagggcgagagtctgtctggaaatcactgtactgctgcaaactttctaaaaacagagtacatgtagttcactgccttttccaataaaccttttaaaatttattctgttttttcaacttagcgtcattacagcataatcttttggtgtaggttataataccaaaatgctttcagagaattaaagtatagggatatttcctacagcatccctggattttggatatatcctacctgcttattatagtggctcttttctcctttactggtagactgtcacctgtcacttccctgtgctggctgtttagtctaatgcactatagcactttctttaaccctttttttttttaatctctacttctgatagctaaaccagagagctaaaatcgatcaagatcaaccatagaactgttaacagagagaggaaagtaggcattctttacaattaataaactaattatgattttgtagtagatctattttataaatctaaatatgtatcagtatttttccaaacatctcatcttttttcagagaaatttactgtggggctcctttgaatagtagaatcccccttttcagttatatacatacatgtttatattctctctatagcacatatacatttgtatatgtatgtgtatatatatactgtatatatactacatgtattaaattctccttatggtatggttactatgtaaatcacctgtaaataaaattattttataaatataaatatttataaatgtaaatatttaatatatttaatattatattaaagagatatgtatgttctatatagagatatgatatatgttatagatataacatatctatatctgtgttatatatgtatgagagtgtgtgtatgtgtgtttgtgcgttctctttctttatggcaagcatattaaaaaaataacagaaatccaagacaaaaattgcttgagtcttttaatcaagccattatcttcattttcattcatgtcactatgtgaatgcataatttgcatagtaatatgtaggaatatcatgagtagattttaatactttatattttcatttaatgcttttctgctgtcttttgtttttaaagttgtttcttcctttctctcagtactccctgtgcacaattgacatgtccaatactcatgcttaatatgcttgtttttatattttcaggtatgaaagacttttttggacttaatcattgtttccattttggcaccatttttgtccttatctcattagcatagtaagcctaaaatgtcctaattccaggaacggataaaaattccattccattttatattcaaaggtttggatttctaccttaatccatttcttaaagtggctaatgatttttattaccctagttgtctctagggcagtagcctttctcaaatcattttagtataactttacaaaatgaatgctgtaaatatactatgaaaccttcttgagatcattcccaactaagaatcaaaattagtgacttatctaaacattcacattcttttatatgttgggaaagttcacatcattgctcttatctgcctctaaattctttctctctggatcgatagtttcctgctggttttcagaatcaagtgcttcttatttttctgaaccttattaatcttaattaggcctccctggctctggggattatttagaatttcttcaggtaaaggtcacacctatttgtagttcttaatctttgcattttatctactttgcgtgtcaaatgttcaatgaaatggagctctactgtagggactcaatttgttagactgagtactctttcacgatcatctatatacatcaggttttattcagagacttctaaaaggagctatgatttttagtttctgaaattccaaaccccaataagccaaacagaacataaataaaaatagtcgtatagagcagcacttcccaacctttttggcaccagggactggtttcatagaagacagtttttccacagactggaagacaatttttccacagactggaggggtgggaaatggtttcgagatgaaactgttctacctcagatcaccaggcattagattctcataaggagcgtgcaccctagatccctcgcatgcacagttcacaatagtgtttgcacttctatgagaatcgaatgccactgctgctgctctgacaggaggcagagctcaggcagtaatgctcccttgcctgctgctcacctcctgctgagtggccaggttcctaacagggcagggaccatactggtccatggcctgggggttggggacccctggtataatggatgtagtatcagtcaccacagtctcctgccttattattccatgaagaaaccaagaaaatagttttaaaagaagattgcgactatttagtttagaacaatgtgctaggtagagacttaactttttcttggctattatcacagatagaataggaatgtttatgtgctcagctggaggggtggcagtttatatttgtatataaatatagattgggataaaggttttgaacttaataataaatggtgtcttaagcttacatgttttagttttcagagcagattatactaacagcagtaacaatagctatgctgagaagaatgcggagaaagaggaatgctcatacattgttgatgggaacataaattagtacagctattatgggaagcagtatggagactcccagaaaactaaaaatagaactgccatgcgacccagcaatcccactgctggctgtgtatactaaaaaaaagaaatcaacttatggaagagatatctctgctcccatgtgtgttgcagcacaattcataatagccaagatatggaatcaacctaagggctcatcagtgggtgaatgaatgaatgaagacaatgttttatatatatatatatattagactattattcagccatagaaaagaatgaaatcctgtcatttgcagtaacatggccggaaagtcaggccgaggaagacaaatacatgttctcattcatatgtgagagctggaaaaatgatcttatggagctagtgagcagaatagtggtaaccagagtcagcaaatagtagggggagtggagaatgaagagaggttggttaatgggtatcaaaatacagttagaagaaataagttctagtgtccagtaacacagtagggtgactctagttaacaagaatttattgtatatttcaaaatagctagaagatctacaatgttcctaacacaaggaaatgatcagtgtttgagatgatagatgtcccagttaccctgatttgatcagtatgcactgtatgcatgtatccaaatagcatatgtgccccataaatatgtacaactgttatgtgtcaataaaaaacaaacaaaaatagctatttcttctaatatcaggcattggtcaaacaaatatacttgcttctttttataacctcataacctaaagggatagttgctgttaatcatttccattttacttttgaggaaacatgtatttagacaagttaagtaactaacctttggataatcactgaaaacatagaagccagctcccagaataatatcttctacaaagtagaagagattatttttgaattagtgtctgagctgggactaaaaatctaggttaatctgatattaaacccatgttcttgatctttgaggtacatttcttctcacttgattgccacattaattatgtccaaaggccagtggcacttaggttctatagaaatatttgtgtggaataaaaattgtgttctaccaattctccttgcagttgcttgtgtagtggataggataatttaaaatcatggcctggttcttgaacaatcttattttgtcatctttgagttttatgaacagcagatggcaacaggacaatggtcagtcagcttgactgagcagtgaaactttgttcagtgagcaccggcactgggaacaactggtcagtcatatcattcagatgggaatggctctcattagctttgaaactcagatattaatgactaattgccagtaagatcaggcaatgctggtcaaccaggcaacttaacctgtgctccatgtggaaaggctgcttttgcagccttttaagtttggttgtaaaatgtaaaattaatttttcaatctcaagtttattcagaattctattaaaaacaattgttctttagccattttggtatgctgttattctttaataaaatatcagactgtgaattattgcctcttctctttaactttgtgttgctgtgttcccaaagtactttatccatataatgaatgcattacatatattatggttatttgattacatgcatattcccagcttaaccaaggactgtttgaaggcagggctgttttatacaattttgtatttaacaggtaatagacttttaggtgatcagtcaatgttgaactaatttgtactgtaaaatgaaagtccactgtttggctctgttgttcataatgtaaatattcatttacttaaatttaactgaacctatagtttagctggaaaagtgaaaattttatctaagaaaataaatgtaagtttaggtttctgaggctgtctattgtttacatgggtaaaaagctaaagccctcactgtacagctatttcaaatgtttaacatatatttactcatttattccttacattagcagaggtagttacattgaaaatactgagtcattgagaggttgagtaactggccccaagacacatactaacaagggttgagctgggatttgaacccaggcagtccaattccagagtctgtgctcttaaccaatattctatgcagcctcatttatctgttatgtgtatgtatgtaagtcaatatgtacagagagattgaaagagactttatcttatattttatagtgaatgttattatcacttcttggaaaaatacagaattttgcagaggaatgtatagttttctaaggtcaactttcaacgtcaagtaaaataatttaaaaaaattttcatgtagatatactttgagagacatttagatgcagtggaatgggtttggaaaaggaccaacaaaagaataaggaaatataaatcatgctattgtagaagacattgtaaacatttcattctgagagaattttataagggaactgcaagtgtttttcagatatttgaaggtagaaattgagagagtttggctttgttctttatagttttggtggacaaaattaaagtctttggtagatgctttagagcaataggattttacaccatttaaggaggaaatttttgcatggaaggtggccttaggaaataatgagcatttttctatcaggatgcttagatagaggctgaaaacagggatgtcactgaggataatcaagcattcggctgattgagtaactgaactaggtgatcacatttaagttaccttctaaacctgcaacttaaagattctaataacttagaagggattctgttttattaatttactatgtaggtgatttctagtgaaacttatgatcattaataccagtggttgcgaaaaaataatgcctgttacagaattattcataataagctcatggaaattcactcatcatacttagtgtttattatgtgtcagataccttgttaagcactttatcatttattacctttttactcttcacagtaaacttctggagtgagaactattattgtcttctagatgagaggttcagaagtgcccatgttcacattaaccagtaagttggcatggccagagcttgaacccgaggctttctgactccaaaacctatatgcctaactactgcacaacctttcaactttctagttcagatcagaaattgaaaatcaaggtaattaacatgacaaggttctcagaatatgatacttttgttatttacataagtagaaaaggttcaggccatccctatcagctggagcagactgctataaaaaaaaggaagaatgaaatagaagaattagggaaaggaaagagagcaaggatgttgtgtaggaactatttcatgtctagttgaaatgtgttataaaacttaaatatgttttttaaagttctgttttgggtggcataaatttataaagcaaaattccttcctccctccttcgcttccttccttccaaagagtattgaggagattttaatcttttttaaatttttattttattttttgagagtctcgctctgtcacccaggctggagttcagtggcgtgatcttggcttatagcaacctccgcctcctgggttcaagcagttctcctgcctcagcctcctgagtagctggggctacaggcgcatgccaccacacccggctagtttttgtattttttagtatagactgggttttgccatgttggctaggcttgtcttgaactcctgacctcaggtcatctgctggccttggcctcccaaagtgctgggattacaggcgtgagccatcctgcccagccttatctttaaattattcagtaaacaacagtcaaaagaaaaatcttagccacattaagttaatagagttcagttgagcaaataacaactcgtgaatctggcagcctcggaaaccagagtaggctcagagactctccagcgcagccaagtggtggaagattttgttttttcactctttttattttatttttatttatttatatattttttattttttattatactttaagttctacggtacatgtgcacaacatgcaagtttgttacatatgtatacatgtaccatgctggtgtgctgcacccattaactcgtcatttacattaggtgtatctcctaatgctatccctcccccctcctcccatcccatgacaggccccagtgtgtgatgttccccaccctgtgtccaagtattctcattgttcaattcccacctatgagtgagaacatgtggtgtttagtttgctgtccttgtgatagtttgctcagaatgatggtttccagcttcatccatggccctgcaaaggacatgaactcatccttttttatggctgcatagtattccatagtgtatatgtgccacattttcttagtccattctatcattgatagacatttgggttggttccaagtctttgctattgtgaataatgctgcaatgaacatacgtgtgcatgtgtctttatagtagaatgatttataatcctttggatatatacccagtaatgagatcgctaggtcagatggtatttctagttctagatctttgagaaatcaccacactgtcttctacaatggttgaactagtttacactcccaccaacagtgtaaaagtgttcctatttctccacatcctctcaagcacctgttgtttcctgactttttaatgatcaccattctaactggtgtgagatgatatctcaatgtggttttgatttgcatttctctgatggccagtgatgatgagcatttttttcatgtgtctgttgactgcataaatgtcttcttttgagaagtgtctgttcatatccttcgcccactttttgatggggttgtttgattttttcttgtaaatttttttaagttctttgtagattctggatattagccctttgtcagatgagtagattgcaaaatttttctcccattctgtaggttgcctattcactctgatggtagtctcctttgctgtgcagaagctctttagtttaattagatcccatttgacaattttggcttttgttaccattgcttttggtgttttagtcatgaagtccttgcccatgcctacgtcctgaatagtattgcctaggttttcttctagggtttttatggttttaggtctaacatttaagtctttaattcctcttgaattaatttttgtgtaagatgtaaggaagggatccagtttcagctttctacgtatggctagccagttttcccagcaccatttattaaatagggaatcctttccccatttcttgtttatgtcaggtttgtcaaagatcagatggttgtagatgtgtggtgttacttctgagggctctgttctgttccattggtctatatctctgttttggtaccagtaccatgctgttttggttgctgtagccttgtagtatagtttgaagtcaggtagcatgatgcctccagctttgttctttttgcttagaattgtcttgggaatgtgggctcttttttggttccatatgaagtttaaagtagattttttccaatgctgtgaagaaagtcattgtcagcttgatggggatggcattgaatcatgaagaaagtcattgtcagcttgatggggatggcattgaatctataaattaccttgggcagtatggccattttcacgatattgattcctcctatccatgagcatggaatgttcttccatttgtttgtgtattcttttattttgttgagcagtggtttgtagttctccttgaagagttctcctcttcaaggagaatacaactcacatgccttgtaagttggattcctaggtattttattctctttgaagcaattgtgaatgggagttcactcatgatttggctctctgtttgtctgttattggtgtataggaatgcttgtgatttttgcacattgatttttgtatcggactttactgaagttgcttatcagcttaaggagattttgggctgagacgatggggttttctaaatatacaatcatgtcatctgcaaacagggacaatttgacttcctcatttcctaattgaataccctttatttctttctcttgcctgattgccctggccagaacttccaaccctgtgttgaataggagtggtgagagagggcatccctgtcttgtgccagtttttaaagggaatgcttccagtttttgcccatttagtatgatattggcctgtcttgctaggttggggaagttctcctggataatatcctgaagagtgttttccagcttggttcctttctccccgtcactttcaggtacaccaatcagacatagatttggtcttttcacatagtcccatatttcttagaggcttttttcatttctttttactcttttttctctaaacttctcttctcacttcacttcattcatctgatcttcaatcactgatacccttcttccacttgatcgaatcggccactgaagcttgtgcatgtgtcacgttgttctcatgtcatggttttcatctccatcaggtcatttaaggtcttctctatgctgtttattttagttagccatttgtctaatcttttttcaaggttttagcttccttgcgatggattcgaacatcctcctttagctcagagaagtttgttattactgatcttctgaagcctacttctgtcaactcgtcaaagtcattctccatccagctttgttccgttgctggtgaggagctgcgatcctttgaaggagaagaggcactctgatttttagaattttcagctcttctgctctggtttctccccatctttgtggttttatctacctttcgtctttgatgatggtgacctacagatggagttttggtatgagttgtcctttttgttgatgttgctgctgttcctttgtgcttgttggttttccttctaacagtcaggaccctcagctgcaggtctgttggagtttgctggaggtccactccagaccctgtttgcctgggcatcaccagcggagggtgcagagcagcaaatattgcagaacagcaattttttatacatatttctttatgtatataggcaatatttctggtaaattcctgggaatgaaacttctcattcctacattatcagcattttgaactttagtaggtattgtcaaatgattttacagtagttgtaccatttacacgctcaccagcagtatgtgagatgtcctgttgtgatcaatctgattgtgtgaaatggtatcctactgggtttaaatttgcctttctgtaattgctaatgaggttgaacatcttgtctgtaaatttgcttccacttttctattgggggaaaatttttcttactgatttgtggatttctttttattatttggctaagaaacctttatgagttatatatacattgcaagtatcctttctcagtctgtggcttgtgttttcactcttttaatgttgtcttttgatgcacggaagttttaaatttttctgtggtcaaatttattcatcttttcatttatggattctactttctccgtctcacttaaatccttccttatcacaagatcatgaagatattttaaaatattttgaatagttttaaagttttacctttcaaacttaggtctctagtcacctttaatcatacttgatatatttagggtgatttaaggtaagagctctgttttatttttgaccctacactctgcatcttttaacagtatccactgttcatgtacacgtggatttgttcatgggctgtccattttatgtttctttgtgtctttttagagccttacaatacctctctatcttaacaatatagctttataataaatttgaatatctgatagggcaaatctcccgaacttgctcttcttcagttatttttggtggggtgggagcagggaggagaggtgatatttttagtccttttattttctttaggaatttgaagattaattgttaagtgacacacacacatacacatacacatgtacacacacacacacacagttcacatttttatgggaattgcatttaatttatagataatttgaggaatgtgacatcatggcaatattgattattcctttccatgaatattggattgtctttatttattcaagccttcctgtattcttaattaatctttgcatcatggggaggagtgtggtgctggctgttaaccagggtggggactattgactaacatctttgctacatctggggtataatagtccactggtactggggcatcaggctaaatagatgagaacagataaagtataaaaattgggtaggtttccagagacccaaatctgtttgggttaaaggcaaatctgtagtttgagtgttcagattgccatcagtaggctggtttggcaggcagagaaggttgacatctctcgatcgggcaaaggattctatctctcaattggggttaatcgggaaacgactcaggcatagagcatcaggactctatagtcatatctcagccacagactaactggacagtatggccagaatctagtcactgaaagactggacaataggataaaacaaggtacagagagacaaagtaaaagggagtaccacctggtactgagactagaagtacagggatatcaagagaatgctactgagccagctcattcccaggcaaaggcttattatgtttcattcttcagcaccagcacaaaggctggaatatcagtggagataaacccaaaggtaggagagtcccaatcagggggaagagggaaggagtggggagccctatggttcctgacatgctttgctccctgatgaggtaatagaaagctgaagcagtatatagctgatataagaagattcaatgtagatagaaagaatatcttaaactaatgtctggataaaactatattaaattaagtattgtttgacaacagctaagaattaatgagaaaagtccttaaatatctctctctctatattttttgagtgagggtatcactctgtcatccagactggagtgcagtggtgtgatctcagtgcactgaagccttgacctccagagctcaagcagtcttcccacctcagcctcccgagtaactgggaccacaggtgtgcacttctgtgcccagctaatttttgtttacctttttgtagggatagtgtctcatggtgttgcccaaactggtcttgaactcctgagctcaagtgattttccttcttcagcctcccaaagtgctgggattatagatatgagccactgtgcctggccaagtatttacatttaaagaaatctcactttaaaagtgtttctgtgtaagtgtagagcttagaattgtgaaggctatatttatgtttgtctatttcaataaataatttatctaaagatgaatcaacagctcacttacctttttatttcagtaaactgaaaataagaagccacaagctctcaaagtacctaagacaaaatacactatttcttgagggctgatctataatcctgagtctataaaatcatagaagaagccactgggtttttaatgttaggaaactgattgggaaacatgttaagtattgatgtgtaggaaagactgaggtgtttgatgacagatgaaagtgaagaaaggctggtgaagcaggagatggaagggcacagtctggggactgtgtgtgtgtgtgtgcatgtatgtgtgtacacacgtgcgcatgtaggtggatgtcttaaaccacagcacaacctgactagaagtgtatgttgttgtagaagtaataactaggcaatgaatggtttcaaaaacatgttagaaatttaagtttccttttgaggtaatattccatagagattctaaaagaggttgctcataaatcaaattgtgaggagctccaacttaattataagaaaaaaataacacagttaaaattacccttaaagtaattagcataatttttttgttttgttgttatttaaataaagaacagaactgttgttgccctgagggaaaaatggataacaggcagtttgctcatgtggcttatactttatgtatgtgtgcatctattgtaatagtaacagataatgtcttctaatagctcatggaagaaattagtttcttttcgagcaaaatggtagccttgtggaagctgacaaaagtcatattataatgatttttggctcaataaagtaatgatagcttggaaaaagtaaaggagtacggcagcagaagaaagataactgtaacaaaacaaattatttgaacaaaagataactgtttctttaattggattctcatggaatattggtttaaaatatgctgaccaaaggcagtatctggaagacaggaacttaggatttctgaatcatagttctcctagcttggattgaattcaattcaacaaacttttgttgagcatctactctggagccaggtggcctgagtgtggttcttggttctactattctacctctctatcagtttcctcatctataaaacagagatataatagtagtctttatcttctgtgatttttttttttaggataaacagaattttaatgtatgtaaagtacttagaacactgtttgccacttttgcacacacagaaagtcaactgaattagagaccggaaactgaaaggtgcttatactgtcttagtgggagagacagataagaaacccaacaatttcagtagtattttctgataataccaataacatgtttatcaaaaggttgctatgggaacccaggaattgaagaaaaaacgaccttagggggatagttttctggaataaaattcaaaaaaggctttcaataggaaaaaaaaaatcccccaaaagctcaggaaacaaaaagtagacaaagtgagaggctggaacacattcatttgtagctttttgagcttccttccttgctggacctaacactacatctggtcaccttttagatacttggtaaaaacacgatagagatcattttaagttctgatactattttcatgtgtactctcagtcacagcatctagttgagactaatggaattagaataaccagaatagcaaactactattccaaagtgtagtgctctgtgctgttagacaaaatattgacttctgggttgagttagaacaccacgaaggagcagcacttttatgtcatggcccttcttttctactctctgtcaatttgaatgaagcagaagagaggcaagtattatccagttagaaataaaagagagggccgggcacggtggttcatgtctgcaatcccagcacgttgggaggccgaggcaggtggatcacttaagcttaggaatgcgagaccagcctgggcaatatgatgaaacaccatcactacaaaaaaatacaaaaattagccaaacatggtggtatgtgcctgtggtccagctactcgggaggctgctgtgggaggatcacttgagcctggaagggggaagttgcagtaatctgagatgactcccctgcactccaatgtgtgtgacagagtgagaccctatctcactaaataaataaatggatgaatgagagaaagacattttaaaccaatatgttaagaatcacactttaggataaccttgatattgtaataatttatgattctctaacctgtgaaaattgtaaattgttaagcaataaagagaaaatacacttgtggatatgcagaaatgtgagtttctcagtgcatgggaagcattgagagaaggaaggtgtccatccagtctgtggtcccctggtcgtccctcgcctcccctatgtatcttgtcttgcttaggttttgacctttgtcttcatgttatcctgcattgctatacaacaattggggcatcttgtggttgaagttttaaggtaaaatgaaaccatggttactccttgctgtttcattggctggccctgcagttcttcatgcttactagctcccttcctgccattgctactacaaaagccctccagacctcctttggtgggaggagacatgagaatgttttttgatctcactgacatcctactgaaatcagggaaagacagggcagtgtaaagctttcagctcattctaacctggcagacttcttcaccattgcagctgtatgctgtctacccaacactggcttacagaatccaaaatggctctcccagagggcttcagaagctgggcagaagctcctaatgtttgtggagacacccccttagtctttctgaatgttttaccatcttaccaccccatcttctgtccagccccatgctgacacacacttgtacacacttgcacacacacatacacacatacatagacaaactcacacattcccccacccctctcccccaacatacagacacaccttcaagggcccagacaatgtttaatctctagttagacactttggtccttatttcatcctagaaggcaatcaaacttatatttcttttctttgagccagggaaactgctttaatattctccttttgccatatctatgagtaactttcatataagctctcaattctacagttctgcatggtccaagcaaagtccttttggaccatcaaaacaaaaccgtttctctctcaagctcttagagaatgtgggttgcaaaacaattgcttctgcaaagctaatttttaaattgctatttggaaaattataactgaacaataatgcctttgtccttggctgtatctgtctgtctctcaaagccaaagctttcagctttgctgggtaaagcaacaagattagtaagaataaaaataaatcacataatatttcaaaaatattatcctgttaaatcttattagctagacctgagttatttcacacaagaagaatactcaatcagctacatccttaaggttgtcataacaaatcaggctgatttccacacatatttataaccggaattattagtttttcaaagatatgttacaggtgagctaacattagatgtagaagggaaacttttgatcaaagtttaaattctgattcctcttgttcacttggatgtctttacgattcatttaaactttccaaaatcttatttctaaaacaggcataacaattcactatgacaatgcagcatattgtctgtacttttggatgctttctggaaggttgtcagcagccaactaaattcattattagagacttacagtgaagggaaatggttcttgaggtgacccctgttcagtccagaaatagcagctctttatttaggtaattaccattgtgaattgctgctaatggccacgttagtggaagtctatgttgtgatgaggaccactttaacattggggtggttttgattctttctgctacttaacattcagaatgatccatagctgaagcttagttactattaaaaatctacagtgttttgccagtgggaattccaattattattgcctggtaattaaaagacctgcttgcctcagagtttttgaaagaacaaaataatacatgtgattgtttcaaacttcaactctatttgaatgttaggtggttgttattaatttttactaactctcttactgtactctttttctcccttatctagttttcctgctctcttttcaatgctttgggaaattcatcttcataaagcttgatttttaattgaagcaaatttttctcagagtcagcaccacagtgtccaaggtcatctgttgtcttagcatcttttccactgtttaatctgtgtcttaaggcttctttggttctttttggatctgtgattgtttctgttttctgaacatgggatatagttccagatacactgcttttttatactgaactacattctgcgttgcttggttttgttttactttgcttttctctagtattttttgagcttagggtttatttttatcatttataaattggtttgaaaaaagattaattcactcagtgttcaacatttgaatcaagtgacaattatgtgcaaaatacagtggtattgctgggatatggtatgagcccagaatgcccaggcttctggcttgactacaggatcagtggtgctgtcattcaccagggctgggactgctggaggtagagctgaagtggaagggagagttggggcagaatgagtggatgatggacaattgctgttagctttgcatgtgggaaagtttaaggtatccagtggctggtgtggtaccttagagaggctctcactccaagtggcagatctaggtatcattagtataaatacagtaattgaagccaagggagtgaatgaaagagaatggagatgaattctctgttgaatgatcaccagacttgccatgtttttctatagatagataccctggttggaagtttgtgtgtgtgtgtgtatgtgtgtgtgtgtgtgtgtgtgtgtatgtgtattgtgtgtgtgcatcccagaatagccatagtggtgtggaggtgtgtatgtcttcagtgtatttggtaggcttcctggaaactacagttttaaaaatgattgacaaccataggctggaacttcttaaccatgttaacatgaatttatagtttgtttattgtggggctgttctgtgcattgtaggatgtttagcagcattcctgatttctacctactagatgctaataagttcctcccacccaatcctcatccccagttgtggcgaccaaaaatgtctttaagcattgctaaatgttccttgggctagataatgccacctgaataagttcttctctgaatttatttacagcattttgggaggagccacattaacttttatgttccagaatgcttgaaaaacacattcatgtctgcagttatcctgactgatatttaggaagcagtttactcctccatcctggaggatcaattgagtaattttaccattaaaaaaaaaatcatttgctgcacataaaagtacagatagctgctagatgcaaattaaattttgttttactttatatgtgtatgatatataaatgaaaaggggtgaccaggacatgttgtactccaaatagtgaaatagcctgtagttatgactcagtcatttcaaaggaattgctgtcacttctttatgtgtcaaatacattttaaggcagaccatcccaaagagtactcttggggtggaggtaagagggtggagtccaagtgcggtgaacatgaattttgtaatagtgatttgaatgtaaaaagttttaaaagagctagtgcttaatatttttaaacttcatttataaattccttaaagcaaaagaatataaaagtaacttaattacctgccatggaagctaaattaacttacaccttgaaaacctcctcttaaaataactcagattttaaagagtcatttgtaaggtaagttgtggcattgttgtaagcacctgcctgtatgtgtgttgctctgaaataatgctattatttattctattatagaatgtagattctgtgaggggaagggttttgcccattttcttcacttttctttctccacctcccacacttccttcatgttacagtacacagtggtgtagagtgtgggctgggttgcagcctcagagagtagttagtatcctgttttagttggctctccttcttctctgacctctgccggcctccccaacagccactgccactacctcacagccaatattcttgatattctggttgaggagataactgaagcctaggagtttagatcagggtggtatcacttctcacagatgaatctttacttctggcatttactcctaactctcaaaaaattgtggtattaaatattttatatgactcctagaattgtggctgtaaagtcccagcctctgtctcaatcttctgtcaaatgaaggaagaagaaaaagatgaattctagcttttgcaacatgtattcagtccacgctcagaggccaattcctaccttcccaaaccgtgatcacagcccttgattgacagaaatgggagggaaaagggagagggagagaagagaagaggtttttcatcttgaagacaggaagagtcatatctggagagctgaggaaggtgggaggcctcctctgtgtacttctgttgtcacttgattggaatgactaaggacattttgaaaccagaaactgcattttatcactgaatgcagaattgggtttaggatcatccaggcttatacaacatagggggaagatggagtgactatcctgtggtaagaatgaatccatcttatgagagtccatggtacagtggatatacagcatgcttatctaagcttaattactggttccatgtatgtacttcggcaagtcacttaacctctctagtcctaaccccacatctgtgaagtccacttagggttatgaagatttaatgtaattatgatataaagtgcttagtagttatagaagcaattgctatggtttaaatggtgaataaacagattgtttattggctcaggaattatgtgataactatttaagaattgtacttctggttgtcccgggagattaggattcttgtttggcttcactactgactagatagtattaatagttaagtcatttaactttgtagaccctggtttccttttattcacaactgttgaagttgaggatctttcatttggtaagcttgggaattctattttgttttgctgtttaaaaacctaggcctcttgttgttaacaatacctctattaactaatttgagttctgactcatctgctagatctaaatagccgtgggaatgtgaagcttttcacaaataatgctatgatttttcagataagtttttgctctccatgcaaatggagcaaattacttaattgacattttacaattaggtattaaagcatcctgttcaaggttggaggacagtataaacttatttaaaatgtctagtgaacacagtctgtcacagggatatgggaaaaaggcaaaattgtattaagatattatttgtaagcaagtgctcttcatttccaagcagtctgtccctgaagggggtgtaaatcatgtgtctgttctgtgcttagaattcatcccttctgccatatgtttattgtataaaccaagaagatcatgtattatcaagagacaacttctactcccggcctaaactttcaaatattattcatactctgttctcataaaaaattattcttagggtctgaaagaccatcattttcttttaggtatttctgtttgtgtatggtatttgcagcaaccaacatcaacagctggtttgttctctcatttttcaaggtaatggtagggatttaagttattaagaatcaaatctaacacacaaaaatactttgaacatgagctgtgtacaaattttttattgagttattaacctattggacattgctgctgctgtggggactttatcacatacatttaaaaactaatataaacaaatggagaatatgagttgacacagaagaaaggctcaattttatgccaaagtaatagctagcactatagcatgcttactgtaggcattacgttaagagctttgtgtgcattatttcatttaagcatcccaactttactacttggttgggtgttattacttcatcatttttataggcgaagaagctgtctcagacaggttaagtaagttgcccatgttcacacaactagtgagcagaagtgctaggggttgaatccaagccacctgattgcaaagtctatgctgaagttgcattttaaagtaacagaaatttccttcatacaacactggacttatttttttctatcaaatgatgtggcaaattgagagatttctggagaaattcaggcccaaacaatgttatcgctcagatcattcagatcattttcaacattagcatttaatgaataagactgtgtcttgaaccaaacatatttataaaagaattagaggaaggtaacttaattctccattcactggtgtcttagttgtaaaaccacattttgacaaggttattggtcataagttattttaatagcttttccaaacttaattttctgaagttaataaaatgctgagaaaaacttagattatgtttaaaagcattgagtgaactaaaacctaagtaaagctatttactttgcatacatatggccaccatctaagatggttacttatccttgaaaggataatgtttaaaataatatttaaaataatctaaacctaatttcttaacattgaaatttttacaaagtatagttatgtataaatctgatactatcttactacaagagatactaaatgagtaacataaatattaagcataaaagatttaattggactgttacaacctactctcacacagtttaaacaaaagtcagttaaataggttgtttgtaaagttctgtatagtctagatttctttcttcttccttctctttcttcaccccctcctcctctcagcatcataatgattatcatcatccccatcaccactgttatcataatcatcatggctatcttttacattgttttcctcacaacatctgcatcagtaatttaattgtaagcaacagaaattaaggagcagtttatttagaaagatatcttgtagtttttagtttgaggacaacctgaagaatgaggccttgtagagctgtgccaagacaggctgctaggcttaagatggggaacagatgtcagcagatattcatcacttagggctaaggtca

SEQ ID NO: 11751 - DNA, 40742 bp, Human
caacaagtggcataagactgaagaaaagagcctgggcacggtggctcacgcatgtaatcccagcactttgggaagctgaggcgggtggatcacgaggtcaggagatcgagaccatcctggctaacatggtgaaaccccgtctctactaaaaatacaaaaaattagccaggcgtggtggcaggcacctgtagtcccaactactcaggagactgaggcaggacaatggcgtgaacccgggaggtggagcttgcagtgagccgagatcatgccactgcactccagcctgggcgacagggcaagactccgtctcaaaaaaaaaaaaaactgaagaaaagaggagggaagatgaatgcctgtggccaaccctcaggcaggtgagtggaacagctattgggggtgactagcgaaaggatagacgttgtcaataaagtaaggcaatcatacaacacatgctgtccatctgtcttgtgcaaatgtgagtatcaaccactctatcatcagtctacaaatactttaaatgtttttatttaaagtcctgttgatggctgggagaggtggctcactcctgtaatccctgcattttgggaggccaaggcaggagtatcgcttgagcccaggagtttgagaccagcctgggcaacatagtgaaaccccatctctacaaaaagtagaaaaattagcccagcacagtgatgtgtgcctatagtcccaggtactagggtgactgaggtgagaggatcacttgagcccaggaggtggaggctgcagtgagccatgatcacgccactgcactccaacctgggcttcagagcaagaccctgtctcaaaaaaaaaaaaaaaaaaaaaaggtcccagggcctgttggggcttgggggtgaggggagggatcttagaggatgggtcaataggtgcagcaaatcaccatgtcacacatatacctatgtaacaaacttgcaccttctgcacatataccccattttttttgtttgcttgtttgtttgttttttagacaaaataaagaaaaaaaaataaggtcctgttgacttaaaacttcggatgaaattgtagtgggacctgtgatctgtttctacattaggatacagtgccttggggcaaggaaatatggcagtgcccgaggtgtcaaggtgggcaggcagatcagtcagcaggggctccaccatcatggtctgcattcaatactggctgcatttcctaggagaatccctgggggaatcattgcagttggagcataatgtagggggcccctgagaaaacctccaggcttcaagtgacatacctagtctgctttaccggtttacaggactcaagagaaaggtggacattgagagttaatccctgaggccaaatcttaaatggagaaagtcaacatccacagaaaatggggaagggcacaagtatttctgtgggcttatattccgacatttttatctgtaggggaaaaatgctttcttagaaaatgactcagcacggggaagtcttgtctctacctctgtcttgttttgtcctttggggtcccttcactatcaagttcaactgtgtgtccctgagactcctctgccccggaggacaggagactcgaaaaacgctcttcctggccagtctctttgctctgtgtctgccagcccccagcatctctcctctttcctgtaagcccctctccctgtgctgactgtcttcatagtactttaggtatgttgtccctttacctctgggaggatagcttgatgacctgtctgctcaggccagccccatctagagtctcagtggccccagtcatgttgagaaaggttctttcaaagatagactcaagatagtagtgtcagaggtcccaagcaaatgaagggcggggacagttgagggggtggaatagggacggcagcagggaaccagatagcatgctgctgagaagaaaaaaagacattggtttaggtcaggaagcaaaaaaagggaactgagtggctgtgaaagggtggggtttgctcagactgtccttcctctctggactgtaagaatatgtctccagggccagtgtctgctgcgatcgagtcccaccttccaagtcctggcatctcaatgcatctgggaagctacctgcattaagtcaggactgaggtgggtctggggtatggcaggggctgggcagcagcagcaatgtaccttgcttgggacccctaaaaaccagagagacagcatggctggtgccatttatcagctagtggaggaggctgacggagggtgggagtgtcatcagcacaaggccctggcagtcccttctggtgattagagaggccgaaagggtcctttccgacaagggctgagggtgggcggaacaggaagagaaaaatgtgacatgaggtgaccatccgaacaggtagcaaatgttagaaaggggtacctctggcaaacttagtggaaaagtaatattgcagggagcagtcagataaaaacaagcccttctgtcaaatagtgcttgaagactcaatagggatacatgggtcaatgaagcctttagaaaaagaaatactaagaggcagattctctgagaacatggtaaaagctcacgctccacgttatgaagttgacctttgtgagctagggaaaggcctggctaggccagggtgtaggctacctgccttgagctgtaccaggccaaatgtcgccagggtcagagctggcttattaaaggactgtgtggaagctgtgccaacctcgtggtaacaatgggtaaaagactgggccaggagaaagcagcctctgcctcagcccagacagtgcggccaacccttgaggttgtggcaaaggtttctcctcttaccattgccctccatgtgcatggcttgcttttctcttgtcttcattatttctcctttcctttcctcctctccaacctcctcctcttcccactcatcctcttttctctacctatatcccctcttcattataccctcctctgttctgttgattaccagaccctgacatacagttagcacttaacaaataattgccgaattgcattgactttttcttgctcctttcttcccccgctcttttcccttttcctttccctttccatttcctcctccctgcctgcctagcaccttccccataaggtggttgtgagcagtaaatgtgcaaatacatgtaaagcttttaaaacagggcctggcaatagtaagtgctggatctcagtatttgctataatttttactctgcctcagacctgccaatgtcccccagagggcctacctagagcaaataatatgacatttagaataaaagtgattggtgaccccaatcaagacatccttggataagttgcccagactccagcctctctggagcctcagttatttgataaaataatgtcactttccaaataagccacaaaatgcaaatactcatggcaacctaaagcattatacccaaacagtgtcccttagggcttgtcctgtctattctgactccttttatattcaaactatttaaactgcttgcttgtgttgaagtccaaatttccattgcgtatggctattgatatttttgtttggaattttttttttttttttttgacacggagtttcactcttgctgcccaggctggagtgcaatggcacgatctcgggatctcagctcaccgcaacctccgcctcccgggttcaaacaattctcctgcctcagcctcccaagtagctgggattacaggcatgtgccaccacgcccagctaattttgtatttctagtagagacggggtttctccatgttggtcaggctggtctcgaactcccaacctcaggtgatctgcctgcttgggcctcccaaagtgctaggattacaggcgtgagccaccgcacccaccctggaattctttgtaaactccttatggtgcgaactaatgtaactttccatccagttatgggggattggtgcaattttaaattatcactatgatttgctatttccatttgagcaaatttcctatagagtttcctttcagtggactagacccatatcaggaagtgacttaggtataaagggaagatacagctttcgaaaaccaaagtttgggcgttctccaaagagttatcagatacccccttctacacccacaatgatctgattgctgagatctgattgctaactactgaaaataaggaagaactagaattttcagtgacacagtgctcagcaagaagctagaaaagaggccttgacatatttgactccaaagctacttggttatgcatgaagccatctggggaggggaaggaggagggagaactcctctgaggaccctgaaacaattgggccacgtgtgactttcagtttctatggagattcatgtgcagtggctgagggcaatctgagagcattggaaacccagaagctttaataccaggctcttctctccgctcttagaaagttctcacaagatgtctttaggattatattggttatttgaatctcaaggagaagctcctctcactgccctacctccctgaactgaaaacaaactgtagtctgttagctcaccctagaagaaggaaattctagagtcaagagaagttaagttttagacaagctggaagttggaatatactggagtttaagatcattgactcaatgaaaaaaaaaaaagatttgtctgcagtaaaaccagagttttaaaaatgattagaaatggaccagaaaagagataaggataatgagaaagggggctctctaaaactatttggaactgaaattgggacaatgtttctggaaactattttggcagtatgtatcaaaatgcaaaatgcacatacttttttgactctggaaatgatgcttgtatagagatcctaataacatgggaaaataattaggaataatgttaaataagaacattagatctttttttggaaaaaggtaccttgaacggatggatggatggatagatacatacatacatgcatacatacatacatagatgttacgaaaaataggtaaattaactgaatgtgcaatatgatctcaaatattataagaaacacacacagaaaaaaatggaaggaatatgccgatatattaatgcctctggatgagtttatgaatgattttttcttttttatatccctgtacttgacatattttctacaataagcatgttttattttactatattttgttttattttgagatgggggtctccctatgtttctcaggctgaccttgaactcttgggctcaagcaatcctccaatatcagcctcctgagtagctgggactacaggtgcaccccactgcacccagctgcgtgtgttattttgatatcgatggaaaaaataaataaaatgtttaagccaaggaaaacaaaaactaggttgaaaaagaaggccaaaagggcacacaagtccagagtgaaagacagacaccccagcagtcaccctcagagcagagggagaatattgaaagtattaccactgatctgatctggcactgactataaacttgcagattggctctctggctctccttccatcatcagttggccagaatatattgtcgctaatgcaagacaaaaagagatgatgaatcacagagacctagaagtttccaaaaccacagaagaaaaatgtaaaatgctaaaaacataaggccaggcgcggtggctcaagcctgtaatcccagcattttgggaggccgaggcaggtgtcatggtgtgcggctgtagtccaagctactcaggaggctgaggcaagagaattgcttgaaactgggaggtagcgattgcagtgagccaagattgcgctactgtaccgaagcctggatgacagagcgagactctgtctcaaaaataaataaataaataaataaataaataaaacatgaactgctgtggaagaaccagagagccctaaggcctcctgtaaatgactacagcaggagagtttccctggtcagcatgcagctttcgaaaattgagtttggcttgatgccttcatcacaaatttggtcccctgtagccttgactatgaagcttatcataaaataattgggtttcactggggcccgaacaaaagcatcttgggaatttaacaagattaaaggttgctttgttgctgtgggtatgatttttttttcttttttctttttttttttttttgagacggagtctgactctgtcacccaggctggagtgcagtggcacgatctcggctcactgcaacctccgcctcctgggttcaagcaattctcctgcctcagcctcctgagtaactgggattacaggtgcgcgccaccacgccaggctaatttttgtatttttagtagagacagggtttctccatgttggtcaggctggctgctctcaaactcctgaccttgccatccagccgcctcagcctcccaaagtgctgggattacaggcatgagctaccacacgtggccatatgtaaattttaaacatgtaaaccaatactgtatatcttttatagatatttacatctgtaatgataatatgaaaacgtacctaggaatgataaacaccaaattcaagatattggtaatctctaaggagggagaagactaagattttggagtacataaaggggtcttgattatatagatagtatttcagttcttaacacgttctcttctggtcccaaggccaaggaattctcaattgaaatctcagttagaacgtgaaggatgcttcttgggactgggaagagattttccgtaggccaaatttaacctcccactagagatagttgataattctaccacatttcatagtgaagcatcaggaagacaggactgaaaaggcaagaaggaatgatgcaaattgcatagtccaaaagataagctggacctaggtttgccagtttgtctaagtaactgagaattcattctgagatcaaaaaatcaaaataatgttcacagcagcattgtttatcactgaaagcaaacaacctaaatgtccatcaacaggagaatgaataaatatattggaatgtattcatcatatagaatattttatgcatataaaaatgaattaaaacatatgaagtagaactagccagataaataaatcctaacatattatattgaggggaaaaaagcaagttgctggagaatgtgtaccatatatatatatataaattttctttttttttttttttttttttcgcgaccgagtttcactcttgttgcccaggctggagtgcaatggcaagatctcggctcactgcaacctctgcctcccgggttcaagggattctcccgcctcagcctcctgagtagctgggagagtagcgttggcccagctagtttttgtatttttagtagagacagggtttctccatgttggtcaggctggctgctctcaaactcctgaccttgtcatccacccgcctcagcctcccaaagtgctgggattacaggcctgagttaccgcacctggccatatgtaaattttaaacatgtaaaccaatactatatatcttttatagatacttacatctgtaataataatatgaaaacatacctaggaatgataaacaccaaactcaagatattggtaatctctatggagggagaagactaagattttggagtacataaaggggtcttgattatatagattgtatctcacttcttaacacgtgaggcaatatggcacaattttaggattttgtagagctaagcggtgagtccaagattgtaatgttatagtccctgtactttctatttgaaatatttcataatataaaacaaagtatatttgaggccaggtgcagcagctcatgcctgtaatccccacactttggaaggctgagacaagaagatcacttgcatccaggagtttgagactagcctaggcaacaaagtgagacccgtgtctctacaaaaaaattaaaaattagctgggtgtggtagtgcacacctgtagtcccagctacttgagaggctgaggcaggaggatcgcttgagcccaggaggtggaggctgcagtgagtggtgatcttgctactgcactccatcctgggtgacagagtgagaccctgtctcaaaaaaatagaaggtatatttgatcaaagttttatattcacagtaagcaataagaaccctagggacagagaagggtggatgttccacctaaacactgtgctttcattccatcaacaatgaaacatccaggaaaggaaacaacaagtgactctagaaattcactagttagacagaatctccttgggaatgatttaaagagggaaaatgtaagaaaacctggcaagactaagaagagtcctcaagtgcaaaaaaagtatagttgacagttaccagagacagatcatccttaccagcctggaggaatattgcagaggaaagagcttaggatcttgaatactctcttatctcctgtatttaccaccatttcctctcttgctgaacattcctagaaaatggagaggagtttgtcacaactgctctttgatgatagccatggagaatgacaggggccccaaggcagatggcatcaacctcatcaaagaccaaaaaacaaataaacaaacaaaaatccctccggtaggcagtgaaacaccacaaaaaaagcaagggctatagatgatataccaagagctacagatggatgaggttggacaagtcacataacctctgtgtcagtttcctcatctgtttgttgtgaggaataaatgaaataatgcctgtaaaatgcctgtcaggtagaagtcactgaaaggaacagaagttccattccatccccctaaggaaagacagggaatggccagaatcttcctagccaattgagtagtgctttcaaggagaaatcaagagaaaacactacttcttggatattttggctaagtagtcatttgaagtacagttgactggttattttattttaaatcatatctcatagactcttcccaatcataggctggctgtgtagttttctgaattttgctctggtattcttcttcttttttttttttatttttattttttattttttttttgagactccaggctggagtgcagtgtcacgatcttggctcactgcaacctccgcctcccgagttcaagcgattctcctgcctcagcctcctgagttgctgggactacaggcgcctgtcaccacgcccggctaattttttgtattttaatagagacgggatttcaccatgttggccaggctggtctctaactcctgacctcaagtgatccgccagcctcagcctcccaaagtgctgggattacgggcatgagccactgcgcctggacttattattcttaatagtattttatcttatgagcgaagataagagcccaagatggtttagtttactgattctgcaagtgctatttctattaattccttggcatactgcagtttgtatgatggctgcactcttgttaataagcttcgtctttctgaattctgttgctccatagggagctgggaggctgcaaaaggtggccctgtaaaaatctttgcatttataatttaataaaggggacattgtaacactggaactccatattttaaatgaagagctctgtgtctattttttctcctcccccatttctttctttctataaacaacagtggtgtgtgtgtgtgtgtgtgtgtgtgtgtgtgtgtctgtatgtttgagacattcaagtcacttccatttccacccttcaccctgagtggagctcagggttagccatcattgtgcatattttgtggtcaaaccgactctgtaggctactgaaattgttttaaaaaaattggggcctttactggccaggcacggtggctcatacctgtaattccagcactttgggaggccaaggtaggcaggtcacctgaggtcaggagttcaagaccagcctggccaacatggggaaaccccacctctactaaaaatacaaaaattagccaggtgtggtggcacacgcctgtaatcccggctacttgggaggccgaggcaggagaattgcttgaacccaggagatggaggttgcagtgagccaagatcgtgccactgcactccagcctgggcaacaaagcaagattccgtctcaaaaaaaaaaaaaaaaaatggggcctttcacaataagtacccacagaagctttaccctctaactactttttaactcagagctgtgtgttacacaccaaccttctggaggactcaaaaatggatccctttcctttcacattattgagtgatggaccagtggcacctaaggaagagctaccacattttcaggctgtgtgagtctggactggatcataagaaacaggagaaaagcagtcaaagaaggtggtaccaaatcatggcaattctggtagacctctagctcaatgatctagaggtggaggccatttcaccttttgctcagaggggcgatggctagtgagagacttgcttacttcctcatagtcagagcagcactaaaccctgcccaaacacagatacttgagagagaggaagacttcctcttgtacaaactggatttgttctaaaacagagaaagagtagaggcagcttccagaaggacctgtcttataggaagtaagagcaggggacaagaatgaaacagatggtgggtctaagcagggaatgtatccaccaagagcctgcaacaaaactaaagataaaatgttgcctgcgatttattcggctaagagaagtacaccagacatggtttgttgggatgcttctgaccccatttactggtcacagtactcaatttatttagggttttattttttatcctgtaatttgagtctttgattgtgaagaggtacttaattataatttgccacaagaataattgtggtatgattacagggctctcaatgagttggtagttcctgagaatagagtagtattatttggttaccactactcctgagtaaatgcataattgtaatgttaaaatgaacctctttgagtttagagctaaaactgagtgttgggaagggctgattgtaaactcatcaatttgtcactccagtgagagaccatttaaaccagggagtcagggtgtgtggcagggtggagggaaaggtttgcactcttgcccaatttttctcaaaatctaatttacaaaatattgaattaatccacctccagaagatagtggcatacacatggtagataagtggcaaagcgatcttccagaacacccctggtgttcctttgacgtattttcgtctccccagcatgagaatagaacctcctacaccacaggaaagagcaaaataacagtgtggatagcccccaggctttgataaaattcactcccttgctttcctagtgtgagcaataatctgcttaaaaagtagaaaaaaactgctggctttattcattctgcttccacggtgccaccaaaagcataaggagtttacttaaaaaatagacacattcccacccccacccccccaccagaggaaaaatccctaccactaattaaacttgaatggagggctggtggttttttcgttacttacttagtgtttttttgttgttgtttttgattttgttttttgagacggagtttcgctcttgttgccccgactggagtataatggcacaatctcggctcactgcaacctccgcctcctgggttcaagcgattctcctgcctcagcctcccgagtagctgggattacaggcatccaccactacgcccggctatttttgtatttttagtagagacggggttttgccatgttggccaggttggtcttgaactgttgacctcaggtgatccgccagcctcggcctcccaaagtgctgggattacagatgtgagccaccgcgccggcctagtgttctatttttatgacagcatttgttttcactttatctttccaatgaaagttcggaattagtaataatattacactgtgcataaactgtaagtgaataactgatatgaagtgttgcttggtgtgaataaaaaagccagtggtgactttgggaactttatttgtctttctgtgtttcagttacctaaattgaatccttctggagtattgtaggtttggggaggctaaataagttgtgtttcataaatgaacagaggtggcatctatatcagtaagacagttgcatcacttttgcatgatgctgtctaaaagaactaatttaagctaaatggggaaaaggtcagaaaacaacaactaccccccccccaccaaaacccaccaaaaaaaattatgttttcaactttagaacaaatcttctatcctttgtagctcagtcagtgggtgtgggcaaaatcagttgggcagcagttagtgtgtgtccagaactgcaggtgcagcctccatatccttattagttcccttggttacagaccccagtgggacaatgtttgaaaaattatattcaccgtctaggaaattgggaactgaaagtccaatatctgcctcagtggagttctggcacctgcattatcccttctgggtatatcaagatcaacagctgcacagatacttttgcttttcacagattctacacatatcatataaaggtgaatagtgtaaagctacctctacaccttaccaagcacacaggtgcgtgccatttaacatctagagcattccattgccttatacaagaactcagtttatatgagctcacaacatcgaaccaatccccccccaattcagtgtgcatccattatacctgaaacctgacagagctgggggctgtgggaggaggttggtaggaagaaattattttgtgagctgtgcacatttttgttccatttgaaactaggtagctaggctgagggggaaccaagagggatgaggattaatgtcctgggtcctcaggaactttcattatcaacagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtggggtaagtttctcgactatgaaaactgagtttcaagatatcaaggacttggccttagatctttcttggggaagaggtaaattttcgttggtaggaggaggggagtagaatggacctaagttctttcaaattcagcaaaatatttcctagcctataactagctaaagccggaaagtcaaaggtcctaagaagccacaaggaaaatattaccatggaatcttggaattgatgagcactcattaaatgattgttgaaaatgaaatcgaagagttggaaattgcttccttacttcctatgaggaaggtacatacagtcattcactcttccatggtatttgccctccatttggtagtcatagatttatagatctggaaggatttttttttcttcccccacatgacaggtcctggtgccacctcactttgttgaatgattagataacaaaatctaatcatctggttgcttaatccctcttaatctttctccattttcttcctcattctacttctcagagaagaggcagtaagaagggttcaatagatgttgagaagatcacttgtgttgaaacagtggttcctgaaaaaaatcctcctccagaaagacagattccggtaagaagagaccaatgtctgagatggggaacagcagatttgaagaaatttgcaacatttaaattctctgtaaatagactggtgatgctgtgcaacgtggaacacggtcaagtttcctttaaaaattcttcactctaccatattggttataaagaatcttagcttctttccttcatattcagaacatctcactaaacatggaaaatttgttaacacaaacttttaaatgatgctatatctagttttcaaactggtcagagatcattgattttattccctcagttctctcaggatcagatttagaggcttaagtaagtctgaatgtcataatcctagggctctgagtcacatgatatcctttaataccttactatttattctcttctcactttccggagcgagagacataaaacctactgatttttgagttcacttttaaaaaatatatatcaatttcagtattttctttttttcttttttttttctttttttagacagagtctcgctctgttgcccaggctggaatgcactggtgccatcttggctcactgcaaccttcacctcccgggttcaagcaattctcatgcctcagcctcccaagtagctgggattacaggtgtgcaccaccatgcctggctaatttttcgtatttttttagtagagacggggtttcaccatgttggccaggctggtcttgaactcctggcctcaagtgatccgcctgtctcggcctcccaaagtgcaaagattacaggcgtgagccacccactgggtctgaccattttcagtattttcttgatcacaggagaattgcgtatttattacagaaactctggaatatataaaaaatacaaaaagattaaaatgatgcataatcctgttacccagttaaaacaactatcaacatattggtgtacatagacttacagatgtttttcttcactgagaacacatacgcatacacttatatatatgtcatatatttaaaacatagactcatagtacacatcttgctttgtaacgtactttttcaatgtaacgatatgtgggaaacttttccccatgacaatagatattctttaataacatgattttaatgactgtatggtattccctattatggatgtattgtaatttgtttaatctcccattattacacattcggtttgtctacaagtacttgatagtataaaccatgttgagaggaacaatcttgcatacatctttctgtactttttttattcttttccttatgataatttcctagaagtaaaattttgttcttctctttaagaaaatctgtgcactttggttatttttatctttttatttcattttctagaagtggaattgaatttcatacacacctacaagctatgtatgagagtgcctgtttctgtacattttttccaacactagatattttgttatttttattattattattattttctgagatggagtctcgctgtgtcgcccaggctggagtgcagtggtgcgatctccgctcactgtaacctctgcctccggttcaagtgattctcctgccccagcctcctgagtagctgggactacaggcgcccaccaccacaccctgctaatttttgtatttttagtagagatggggtttcaccagattggtcaggctgatctcaaactcctgacctcaagtgatcctcccacctcggcctcccaaagtgctgggattacaggcgtgagccactgtgcccagcccaacactagatattttaaatattagttaatttgacagccaagaaaaatagcatttcaggtggggcgtggtggctcacgcctgtaatcccagcactttgggaggccaaggcaggcggatcatgagcaggagttcgagaccagcctgaccaacatggtgaaaccccgtctctactaaaaatacaaaaattagctgggcatggtggcgcgagcctgtaatcccagctactcgggaggctgaggcaggagactcccttgaacccaggaggcggaggttgcagtgagccgagatcgcaccactgcacatccaggctggacgacagagcaagactccgtctcaaaaaaaaaaaatagcattttattgctaacttattttgcaatttcttttactcataaagttggtctactgctcatttatattttaattttgtgaattgcccattaatttttggtccattttttacattgagatgtttacctcatttctaatacttttaaagagatcttgatataagaacatttatcctttaactgtaaagtatgttgaaaatgtttttcagtttatcctttatctttcaattttgtttatgatgctttttgccatatagggatttaaagtctatgtcatcaaattagttcaggtttttcttaatagttctaagtttcatccttatattagaaaaagcttgcctcccacaggattatataaataattgcttatatttactctcagtcattcatagttttattttttatattaagctcttgaatccatctggaattttctttggtgtatggtgtagcatagctacctaactcctctcctccccacaacgttagtggttaaatatttgtcccaacaacaattttttagaaacctccattttcccagtgatttgaaatacctgagtctctcttgactgggtatgtgttgggtcgtattggatatgtgtccctattggcctatagaaagtaatcactaagaatcagccttgtctgtgcaggagaaacttctgaagccacagcaaaaggcttctagtacctaaggaaattcagaaaagagcaatgcatcaaccaataaccattttttcttatttcattacagagaagaggtgaagagtccagtgaaatggagcaaatttcaatcattgaaaggttcccttatcccttccaggtgagttattttctctcaccaaatctcgaaaggcccctgtaacacaattagaaggggtggtggggtgcagggcagagggaaggctacgaggacccagtgaatagaagttgaggtggacaaggatgctgaaccaagaaatgagactggcatgggctaagaatgtttgcttttctatttacctaatctaacatagtttcttttagtctctatacctcaaaaagaatacatagcagcaccaattctatcatagtgtgtcttgtctatgataactgcattgagaaagatgctctgcttgttgagtgagcatttcacttccttctggttctgactatctgtctaatagtggtcatgtgggttgaaaagatagaaaaggggagtagtattaggaagttcagtatgaggaagacttattagacttatgcataaacctaaattctgttgtaatctggaagagctgaagtgccacatatgcatctgtttaggagagcaagaactacaaatttggtcttcagtttggcttgcttacatcctgagaactctgtaggccacatgtcgtgaatatagcagcctctgcaacagtgaaagccagaaaaggaagtggaaagtctcaggggagggggctttctgtcatggatttatgagcacagcaagactaacaagcaaaaagaaaaatgtaaaaggatcttgttcgtgtccctgactatatcaaatttacgaaacctttgaaagaggggtatttcagacacagtttttactaccaatgcctttcaacaagatgacattgtttggctgcactagtgaacaatgctgaacagcagataattttaaattaatttatatttgacttcagaatttattatgtgatgtctataaactctgtgagggttggaaccacatcttatatatttcatgcatcttcgtaacacctagcatgatgccttgtacatggttaaaaaaatactatttgacttgatgatattgcttattatataccttaccctttttgaagtaggtttgtagttccaaatttgatttattttggctaatattggtgaggggaggccactaggtagtggaggtggaggtaattagccatgaattaaaattttactccatattatccaagtgaataacccatatgtactaatcaagacttaatttatatagattatcacttcatttctcttctatacaaagtcagaatttaataataagataaaataccctttgttggataaacaaaaatgttatctccagcaagggcagacggagaccttataaaataagtttatgcatgaattgaagcacaagtcaggaggacctaagagtatgaaaaattctaagagcttttaaacgctacattcctagatatgaagagttcaggaatccttcagatagttcacataacctgaacaccattgctgactgaagattctgcctttctttgttttctacaataaatatacaaattgtcccctaagattagtactttcaaggtctttctccttttttctgaatcctaactgctgaagtctgtgttttcatcgacccaggttgtatatgatgaagggcctctctacgtcttctccccaactgaagaactaaggaagcggtggattcaccagctcaaaaacggtgagaattatttggaaaataaatgtttccaaagaaagaaggaaaggaaggaagaggagatagacgggaggaaaaggaaagaaggaagagagaaacgagaaagaaagagaaaggagaaacgtagagagaaaagaagaaaaaaatggatagaaggggagaaaagaaagagagagggaggggaggagggagacaggaaggaaggaagcaaggaaagaaggaaggggatgagggaggaaagaaagacaaataacaaagaaacaaaggaaagtttgtattttgtttcaatattagtaatacaattgagcttagtattccatcatatgaataaaagataaaatattagactaagagtttcccagttctatcactatctctctagtgcaattttgtaattttaggcacctccatttctctatttattaagaaaagtcccattttttgcactgaatacaagggtggtgtggcattcaatggttatgcaatatttagaatcctaagtataaaatacctagctccaaaaaattaaatagatgatgtatgagagtgcttgaagtcagagtcagagaacctggtttcaagccctcttttaccatttacaaactgggtgatttctggcaagaaggccaacaagcttctttgatgctcagtttcttcttctcaaaggagaataatggtaattcatgccacatctacctctggggttgttgtaaggatcaaatgaagtaataatacatgtaaaagcacatggaaaactgtaaatcactgtatacgaaagcactgtacatctctttgttgtggataaatatttcccaaggaaatatttcatattccttgctttgtgaggacctaaacttgaacagtttcagcatttcacatcaaccatacagtgtgttcagataaacttgactgtaaatgcttgcagcacaggatgcatgcacacatatttgtgtgtatatatagccacatgtcaagtgactgagagattaactggttgagttgacatcaggaaaggctgcctagagaaacaggaaggatggcagactgataatggtatggttgggttattgcatgacagccctttgtcttaataaacatttagattctgatactcactggctggctataccagccttgtacactcccttgaatgcaagtttggttggtcaaaattatattagccaagtctttcaaactgaaagggaacaggaggaacgaagatgaaggatcatctattcaattattgctatgtgccagatattgagctaaataccttttatatattatctcatttaattttcacaacaaccttggcctaaaaacaacaacaatgataactaacacttaatgagcacttactatgtagcaggctctgtcccaagtgcttcaaatgtattacttatttgatctttgcagtagccttaagaagtatgtattattcccctatttacagatgaggaaactgaagctcaaagatgttatgcaacttgctcatgggcacacagtgaatggtggagcctggattcttatcacatccctgtgtctgtatgactccaaagcccaagctcattgcatagttttgcgctgcttggtttccaagtccagaaatttcacatgtagttggttgcaaaatattctatagtaaagctatgttgaatattacaaataggtgatatcctgcaatacacagttcagttcttggcatattttaagataaggggtctgctttagccctggggctacaaaatgagcaaactctttaatactgcttattgtgatacaggctcttctttaagttctttacatatattaactttgtattaaccatatgaggcagttatcttgtcatccccattttacagataagaaagctgaggtacagagaggttaagtaacttgcccaaaggccctcggttggtaaatggcagggtcaggctttgaattcaggccccagactccatgtcctgaaccaatatactatctccagccacagaaatatttgcagagactgggataagagctctgcaggacatgtatacttgtacttctttagttctctccacaatgcctcatacagcgccttgcacacagaaagggatcagtagttgtgttaactgatttatctgtgggaataaacaaccatcaccagcttgggctccacatcgataaatggctaggttttagtctggaaatgggggaatgcaaggcagactagctgaaggagaaataagggagaaactggcatgctcaagttggtaacttctttacacttcatatactaatttcaaaaccagtcatagtttagtccaacaaatatttatttatttatttatttatttatttatttatttatttatttattttgagatggagtttcgctcttgtcacccaggctggagtgcaatggcacgatctcggctcactgcaacctccgcctcccgagttcaagcgattctcctacctcagcctcccgagtagttgggatgacaggcgcctgccaccatgcccagctaatttttgtatttttagtagcgacagggtttcaccatgttggccaggctcgtctcaaactcctgacctcaggtgatccacccgcctctgcctcccaaactgctgggattaaagcatgagccaccacacctggcccaacaaatatttattgaatgtccactatatttaagggtgagtaatgaccgaagataaggatatccagcttgtgagcttgtgagctttctttttttcttttttttttttcttgatatggagtctcactctgttgcccaggctggagtagagtgacgtgatgttggctcactgcaaccgccgcctcctaggttcaagcaattctcctccctcagcctcccgagtagctgggactacaggcgtgcaccatcatgcccggctaatttttgtatctttggtagagacagggtttcatcatgttggccaggctggtcttgaactcctgacctcaggtgatccacctgcctcggcctcccaatgtgctgagattacaggcgtaagccactatgcccagccgagcttggtttcctaactcagatgttaaccttacaatcttgattatgtgctgcttttaaggttcattagctaagtaaattcacaacaggctaaaaataaagccaaaataaataaacagaaacaccatcacttcagctgggtcatcagtgtgatcagggagtgtggctaggcacatctttgccttctcttcccttatgtttcaccaaaggcattttttttcccagtagttccacctgggtatagtcttgttgaaccgtcctgggctaacaacaagagccaaaaagtaggcaccttctgacaaataccatgattgctgggagatttaggtgcaagtcctaacaatcccaggacagtcccaggtgctgccaatgtcaatagtgagttagcctaggagccacaaaataatgatattattccactctttttgtttttttcttgtttgtttttatgtttttattatcctactcttgggtaaaatgcaccaataagaaatcattgacatgaaaaggggacctcatgagaatactggttacctttgcagggatattgactgaagaggcatgaggtgctggatctcaaggaggttaaatgggtgtggaaaaatatggtttgctgtacacattaaatctgtgcactttattatatgtaaattatacctcaattttatttatttatttttttttattttgagagagagagtcttgctctatcgtgcaggctggagtgcagtggcacaatctcggctcactgcaaactctgcctcctgcgttcaagcgattctcctgcctcagcctcccaagtagctgggattacaggcgctcaccaccacgcccagctaatttttgtatttttggtagagacgggatttcaccatgttagccaggctggtctcaaatgcctgacctcaagtgatctgcccacctcagcctcccaaggcgtgagccactgcaccaggcctatacctcaattttaaaagcatagcctcagatacctcatatccagctgccacattttctcaatggtgcttgccatgcaaaggttgtattcctgtgggcttagccacagactctctctttccatttccttaaatatggcagtgggcccttctatgttccagcaccacaaatatttgcctatacttattcttgaatctttggtcaagctcaatagaacctatcctaattgcaaattcaaaagtaggcaaatgacctgacctcaccaaaatgaataagagaatagcattggcaaatctcctacaaacagtatggaaaggaatgattcatgtatgcctgaaacagaattttagacattaacctcataaatatggatagaaaagaccagcccatcaagtgcttggagaatatgtactaaccattagtgcttcccaataggggaatgtgcattggtgaagcaagcagtctcccccagccctcccacttgtacaccctgcttttgcaatcctgtcctaagtagctggaaataccagctttggattagccaacaaaagaaggggtgtcatcttcaagggacctcttaagaggcagacattatttgagaatgtagggaggtttcttaatgagtgtgctaggggtggggaagacaagaagccttatttcccctcattatcgtattagcaagcttagtttattagagtggctaattgtcgattaggtattctttggcatgtctactggtgcccagccctgcagaagacagagcaaacttgaggatcttcaaatccctaggtgacagggagtggcatgcggggaggggccagagtgtggatgtggtaggagtaatcaatcctggcagggaggagtatcaatgacattgttcacaactctaccagtgcttagtaataacaaaaggcagacagactttgggtcggttttattattgttttaaaattccctctaggggctgggcgtggtggctcatgcctgtaatcccaacactttgaggggcgatggggggcgggtgaatcacgaggtcagaagttcgagaccatcctggccaatatggtgaaaccatgtctctgctaaaaacacaaaaattagccgggcttggtggtgcgtgcctgtagtcccagctactcgggaggctgaggcagaagaatcgcttgaacccaggaggtggaggttacagtgagccgaggtggcaccactgcactctagcctgggcaacagagcgagacactgtctcaaaaaaaaaaaattccctctatgcaatgcagtcccttatagcctgcactctatctgaacagctcccaccattctgtccttggtacactggtgaagaggagtgctgaaaaagtcagggtgagggtgggtaggggagaatggtttgaagttttcaaatctatgtggagaaaagtaccaaaatggctcttaaaaaaaaaaaaagaacttttgttcatttgcctgcaaaatgcaccagctactagcagcttttaggctttcctgcaaagccttaagtgagtgaagtgtgactagcaagcccttaaggatttgagttgtttctttttcttttttcttttctttttttttttttttgagttggagtttcgttcctgttggccaggctggagcacaatggcgccatcccagttcactgggacctccacctcctgggttcaagtgattctcctgtctcagcctcccgagtagcagggattataggtgcatgccaccatgcccagctaatttttgtatttttagtagagacggggtttcatcatattggtcaggctggtcttgaactcctcacctcaggtgatctacccgcctctgcctcccaaagtgctgggattacaggtgcgagccaccacacccagccggattttagttgttttctacagtggaaggttttgttttgtttttgtcttttttaaaaaaagttatgccagccactggacctggtggtgagtgcttgtagtcccaggtatttgggaagctgaggtgggaggactgcttgagtccaggaattcaaggcctgcctgggaaacacaggaagaccccatctccaataataataataataataataataataataataataataataataataatgtgcgggattcttcttagctgtaaatgctgaaatgtatatgttctcaaatgtgcgtgttcctggaccagcctgggtctttgctctagtgtttgctgctatcagttatttcaattgtctttgcttctctcagttatctgacactatgaaccctggatgacttttctttttttttttttttgttgagacagagtctcacactgtcacccaggctggagtgcagtggcgcgatctcggctcactgcaacctccgccagccaggttcaagcgattctcttgcctcagcctcccgagtagctgggattacaggcacgctgtaatttttgtacttttagtggagacggggtttcaccatcttggccaggctggtcttgaactcctgacctcatgctccacccacctcggcctcccaaagtgctgggattacaggcgtgagccaccgcgtctggccaacttttctaattgacttcatgtgaaggtttttgatatgccatagtattataaacaccaatactaattcctcctctctgcatccactctattctttgcaaaatacttttactctgggagatcttttgggcctcacaactccatgagggaatgaagctgctgtgttacctctggcaatgagctcagtctacctcagtggccctaggaagattcaaatcatgttgattctagaggcaaagtcaccttcatttgcccttgagatcagctctgttgactattctatacagaaagcctcatgcagaagttctcactaaggctaattatccctaaaagatcactcaaggaactgagaaatcagtattaaaagctggggagattggcctgggcacactgtttcccttatctgggaaacacttgccttacaggaacattgtaatggctactgggaaaacatagataacatatttctgttgttgggctctcaagccatcagatagtcttatcttgttgattgggagatactcctcatcacagaccactaaagaaaactgcacaggaactgtctgggaccagggcacagtcaggcaggccagtcatgtgagccaactggtcctgtgatctgctctccttcagggtggccaaggagggggcagttgcttgaagttcaccactaagctcaaagaggaaaacatgcaaatggtggcttctcctccatgtcagatgtgatctctctcttctttcctgctacagtaatccggtacaacagtgatctggttcagaaatatcacccttgcttctggatcgatgggcagtatctctgctgctctcagacagccaaaaatgctatgggctgccaaattttggagaacaggaatggaagtaagcaatctgatcgatataatttctttctcctttgactgtttccatcactctcccaagggtctgtcaagcccagggtcatagcataaggttgtacactttgggtgctaaacaaagggtcctgggggagggaggaggcacatgggggctgaaatccagctggtaatctgctctccaagctatgtgacctggcatgcctagctactttttctaacttgcctaaaggcactcaatatggacggcaaagtccctgaccaaacctgtccttggcccctttcctaaagtgcattccatatcatcactggcttcttgttttgcaggcttaaaacctgggagttctcaccggaagacaaaaaagcctcttcccccaacgcctgaggaggaccaggtatacagggaaactgggtgctgccactgcttaaatggaaacttatagtcaagccctaagaacacactagagtcttagaattaccctgggacttggcagtgttaattggtattcttgctaagatgggggatttgttcttctaattaggatttcctcctcgatggaaagatagaaggctctcagcaaccatgtaatccaatcacctgtttagaacaaaacctgatttttttaatgtaaagtttttgttgttgttttgtttttgcttttgtttttgttttgagacggagtctcgctctgtcgcccaggttcgagtgtaatggcatgatctcggctcactgcaacctccgcctcccagattcaagtgattctcctgtctcagcctcctgagtagctgggattacaggcatgcaccaccacgcccagctaatttttgtatttttagtagagatgggggtgtcaccatgttgttcaggctggtctcgaacccgcctcggcctcctaaagtgctgggattacaggcgtgagccaccgtgcccagctggaaagtattttcaaacatacagtaaagttagaagaatttaacacttaataccaacatactcaacacttagcactaacaccacctatcactaacacttcagaagttttttttttttttttggttccttcttgagggctagaaagccctttctcacatattgtaagtaagtagagcaggtattattatactcattttacaaagaaggaaaccaaggttctgagccacttagtagattcacgtacaagtttagtgccaagccggtttcctgaccttagctataaatggtttttgtctagtgagctttaaaaatagtaatgtttgggtcccattcctgagagtttgattttgatgtaattggtctgtgaggaaactgactaggtattggaattggttttttgttttttgtgggtttttttttgagacagtctcactctgtcacccaggctggagtgcagtggcgtggtcttggctcactacaacctccgcctcctggggtcaagttattctcctgcctcagcctcctgagtagctggggctatatgcacacactaccatgcccagctgatttttgcatttttagtagagatggggtttcgtcacgttggccaggctggtctcgaactcctggcctcaactgatccgcccgccttggcctccgaaagtacattggaatttaaaagttccatacatggtctttatatgtgtgcaaggctgagaactcctgcactggtgcttaaaaatggttgttgaatgactgctgagtaatattttagtatgcctgatttgggtgtcttgagtaagccagagagttgggagagaagagaagagtgcttggtatcttgacaaaccctcctaccttttctcctaactacatagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggtgagtccacaccagcccttcctgagcctggtgcctgcccactccctacacgcaaaaagtgctgcggcataattcccgtgatcagcatcctcatcagagactgttcttcccacaccagactgaacatgctctccctccaagtacttcccagcgtgcagctccctatacatggcctctgccacatctctgagcctctgttgttgggcacatataaccaatgcaacatgtgcataagctctgcacctcactggctcactgcctaaccatgcatcagagacatgattgtctttgagggaggtgcatgatacatatacctccatttgagatttgttctgagctcagggacgtgggcatatgaatctgtctcctggaggctggggaggtgctggatgaactgccacattgtttccttcacaggcaggaaggctacattcctagtaactatgtcactgaagcagaagactccatagaaatgtatgagtaagtatgtttatgtcagtccacaatcttccaggaggaactctctctctctatatatatatatatttatttatttatatatattttatatatatttatatatatatataacacacacaagtgtatatatgtatacatatgtatacatacactggtgtatatataggtatattatgtatacatacacaagtgtgtatatatatatatacacttttttctactttcaacatattttttatttcaagatatatattaaaattagtaccatctgaatcaaatgatgccaccacctcaaattagtgtatctgtcttacctttaccccccaaacaccctccatttatgagagctggagaggtcaccatgccctcaaatccagaagaatcacactcaaagaaaaaggagttgacgacctgatgaaagaattaaaatgtcaaactgctactgttgtcctttcctccctaatcatggaagtggattgttctcaagtgccctagtccctgatctcttccctgcaactccctgctgcttgcctttgcctgctactctccatttccatgaatcttcaatgccaacctgggtttgggaaagggatacagtgtgctatgcacatgacagatgctcagtaaatagggtttgagtgagttgactgaatcactgacatggacaagccctggagggtgctgtaacctccaatctgcttatgaccaggagccactcaagcagcactctcccttcacaggtggtattccaaacacatgactcggagtcaggctgagcaactgctaaagcaagaggtaagtgtggaaccactagcacacagcattctccttgcataagtgaggatcttgaactgagggcctgttctgccccctacctttgggcaaggcagtgtcaaagctgccatcgtctgggatcccaattacaccattttttttgtttttgtttttctgagacggactctcggtctgtcacccaggctggagtgcagtggcgtgatctgggctcactgcaacctccgccttctgggttcaagtaattctcctacctcagcctcccaagtagctgggattacaggcacatgccaccacgcccgactaatttttgtatttttagcagagacggggtttcaccatgttggccaggctggtctcgaactcctgacctcaggtgatccgcccacctcggcctcccaaaatgctgggattacaggcatgagccaccatgcccggcctgcaccttttaatattaaaagcaatgaggctgtagctcaagcgtggaacttggcagtaaaatcaggggttgttctattttctctctcaagtttgggcaggtgggatgcaggtgtgagcaccacttcctcctacagacagcttctttttcgttgtttcaggggaaagaaggaggtttcattgtcagagactccagcaaagctggcaaatatacagtgtctgtgtttgctaaatccacagggtgagtgctactattccaaggccctgaggacaaagaacaggggtaccctcctaatagctccttgatgctgtgcccgtcccacttcctctgtctctgaaactcaaaactcatctcacttcacttcctgggttctgttgacctttgtgcccaagttactgactaagcatccacttcttcagggaccctcaaggggtgatacgtcattatgttgtgtgttccacacctcagagccagtattacctggctgagaagcaccttttcagcaccatccctgagctcattaactaccatcagcacaactctgcaggtgagtaccaggggcaactgagaagggagttacagacaccaggataagcaatgcaggacaaggtgataagaggaagaatctgcctcacaggacagtgtgaattcactgtgaaaggaaatccctgtgatactgggtagaagctggtaaagaggtggtcagaggcagacctacacccaacagggactgactctttatttggtgattgatgttcagtgttaagagaagacacaaaagaggctggtgactgattcatcagcaagtattcattgagttcctactgtgtactcagcgatttcctcagttctagaggagaacacgggaacattctgagtcgaggtccttgtcctcaaagaacatacaggttagacaacatcagaagaaagtttataagcactgtaaaatttctaaaaactgagacattagtgagggcatggatatgggggaacagcttcatcaagaaggtaggatgtgagctaagcctgggctgggaggtgggaatatattcagttaggcagtgtatttcaattagtattttctcttttttgtccctgaaaagtattttgtgagaggagaaacctctggaaatatgtgggttcatggaggtcttctgggattcaaaatgtactagaaagatacacaccggaagtgtgaggctttaagtgaggatgtgtgaggcatcccacctcctacaccacaccaacagcatgacctctctctctgtttcaggactcatatccaggctcaaatatccagtgtctcaacaaaacaagaatgcaccttccactgcaggcctgggatacggtaactccttatttctctggggtagggtggactggccagttgcaaaaactacctttgctggccttgccttagggagtgtccttgaggtacactgttctgcagcagctgcctcaaggacgctcaagacagatccaagcaaaagttattcactgattttcttcctctagtggctacgactgggactgcaaaaacatagattcataaagggctttgtcgttgtcttgggtctttttgtcttttatttttaattgtgggaaaattttcagtactatccctgagttcattaactaccatcactaacataatcataaagggatttggggaggttgcttagtctatcttcttgccttatggccaccttgaacctaaaattcccagattcctctaaccaatgaatcccgtttctgagattgacttaagcaaagacagattagtacttctaaaaatttcccttttactagttttcctatttctaccccagtagggatttttgtctattgtaagaattatacattcatgaccccaaagaatcacaccaagactttattgttaggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgtgagttatagcccaaactcaactctcaatctatttgctggagtctaggaattcacacaacaacccactgaggcttaaagatgacttacagtaagagaggtttgggacgagggactgaagtttacctttaactggcggtagtcctaagtgctaagataatagtttctgtgccttagatattggttgagaatagtggtgatcatgggtgtgtaccatctcagtagcatttgggggtagatgtagaaaattaaactttcaagagaaatattctaatttagccttagcgttctttcattcctggacttgtttctttttcaattgatgggctccaaatccctgcttgcttccacattttaagcacttttgagatttagggtgggaaagaggaaaataaacttgctggtgtgaccccttatctgatgctctactcctaggtcagccccttcctccccagcccctttattgctattatgcagagccaaaaggagaagactagttccttgcctttcctgtaggaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggtgggaccttagaaggattggcctaggacaaagggctgatggggtggaagtagcagtggaagatatatcatacatggttgaggggggctgctggtgccatcatttcaattttatctagaaagtactataagttaggcgtgcctctgccccagtgctgagcccatcaaatatctccagcctcagctccatgaagtctgccgtggtgggaatcagagcagtcactcactcccaaccccctaccacccacaagaaaatggtggggtctttcagtggccattctggatttggaacagaagggactgtgcttcccaatgggactgctcctggcatggggccatcatttggttccttcagagtcacatactggggcctgtggatgcatttggcccacatgtgtgggttttttttatgttatataataattagcaaacccttaaaaagaaacatttcgcttaaaaaaaaaaaaaccctggaatttccagcttctcttgaaaatctacaccgtctggaaataccaggtccacattctcacgaaccgcctcctttcctctaggcatgtactctccatttcctgcaatctcgatccacttcacttcactcttacttaacttgcctggcccctgtaagcatcagagtttgcgcccctgtttctttcagtcaggccaaggctcaaattgtcctagtctcactggcagaaaagcagaaagcaaaaaaacttacttctcattctcccttctttgttttttgtttgttttgttttgttttgttttgttttgagatggagtctcgctctgttgcccaggctagagtgcaatggcaccatctcggctcactgcaaactccgcctcccagattcaagcaattctcctgcctcagcctcccaagtagctgggatcacaggcgcccaacaccacgcccagctaatttttgtatttttagtagatggggtatcgccatgttggccaggctggtcttgaactcttgacctcaggtgatccacccacctcggcctcccaaagtgttgggattacaggcgtgagccactgcacccagcctctcccttaattctttcagcatatcagtgagggaatggggtggtgtggaattgcccatgagaatgcaatcgttctgtatgtcctcagtgctttacctaggactacacagcaggttgctttccacgtggtggaaatgaatcaaaatttcttggtggcatcaacagattcctattaggtgggaaggtgtctgtagtcgaaggagatgaagcttccctggcttcattctactggtcagcagaagctttgtgcctttaacctctgtgctggggacggagtctcactggtctctgtttgcactacaggcagctcgaaactgtttggtaaacgatcaaggagttgttaaagtatctgatttcggcctgtccaggtgagtgtggctttttcatctttccctccagaagtaaaaatagcacagtatgaaacatgggtaggtgttacagttttaatcctctccttttcttttttttctcattctagcgttttctgccgatctttctattctttttcttcctctgagttatttaagccacctctttcatccttttgttttattgtcatatccctttccttcctttctccctttatctctacctcctcttttttaaatctatttccccaataccttatcttgatctattaatcctgatgactttactccattcctccttctttcttaatcagtctaattcccagtgacaactgcagataaaaggaagggaaggagaagagcagagaaaggaaaggtggatagagaagaggaagggagtacctactagatcttatttcacttcatccttcttgtaaccatattgtcaatcaggaaagctcaatcagatacaaaaacaggaaattcgttaaaagtaacgtttgtagaagatactagttgaggaggagagacttttgagaaagcctgtgtgtgtttgtgacactcttgtgaccgtgccaagaaaacgtaagcaaatatcaagcctccaaatcctaatgcaacaagtcctgaatcccttgcaggtatgtcctggatgatgaatacacaagctcagtaggctccaaatttccagtccggtggtccccaccggaagtcctgatgtatagcaagttcagcagcaaatctgacatttgggcttttggtaagtggataagattacacagattatacagctcaaaggataagaaatgcaatggggaaaattcacactttgcaacctccacagagatattgttcttgctttcattcttccaatccttggggagtgcttactgtgtgtcagccaccacaggggtttctgaggatgaaaactaaactggacatgatctctgcctttttagaacttaaaccatgttaaggaaaacaattcattcagttttcaacagcttctgaatactgattatgtaccaggcactctgccagaccctataactgcaaagacaaataagatgctgtctctcttctagaggagttaatagtctagtacgaccttgatctccatctagtgtggtcagtactatagcagaaatttgggcaaaatataaaaagcacagagcggggaaccaactgattctaatctttgaggttgatctaggaagactaggacccctgctatccaaaaagactgcaaaccaatttaataatttttttcaccttctaggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgaggtaagtgctttattaggatctcttaaattatttccttgaatctacttgcccatttagctggccattcagccaccaaagactgatagctgcacacattcttttttttcctttttttttttttttaatttgagacaaggtctcgctctttcacccaggttggagtacagtggcgcgatcttggcttactgcaaccttcgcctcccagattcaagcgattctcatgtctcagcctcccaagtagctgggattataggcgtgcaccaccacaccaagctaatttttttttttttttttggtgacacagtcttgctctgtcacccaggctggagtgcagtggcacgattttggctcactgcaacctctgcctcctgggttcaagtgattctcctgccttagcctcccgagtagctgggactacaggcacatgccaccgtgcccagctaatttttgcatttttagtagagacagcatttcaccatgttggccaggcaggtcttgaactcctgacctcaggtgatccacccacctcggcctcccaaagtgctgggattacaggcgtgagccactgagcctggccaattttgtatttttagtagagatggcatttcgccatgttgaccaggctgatctcgaactcctggcctcaagtgatccgcccacctcggcctcccaaagtgctgggattagaggcatcaaccaccacgccaggccttgcacacattctctgaccttggcctgcaacttgatcatctgatggccagaggctttcccaggcccactccgattctcactagagtgtcattagtacactccaatgccagctcagctttagggagtgaggtgttgtggggccatgtcatctagcataagcaggcagccagaggcattcagacaagtgaatgggcattacaaaagaaaagtcatgaaagtttgttcattcctttgtgtgtcattggccctttcttctactttattagctgccaaccgtttctggctgaggtcctaaatgagatttttttttttttttttttgagaccgagtctttctctgtcgcccaggctggagtgcagtggcgtgatctcggctcaccgcaagccccgcctcctgggttcacagcattctcctgcctcagcctctcgagtagctgggactacaggggcccgccaccacgcccggctaattttttgtatttttagtagagacagggtttcaccgtgttagccaagatggtctcgatctcctgaccttgtgatccacccgcctctgcctcccaaagtgctgggattacaggcatgagccacagcgcccggctaaatgagattttttttaaaacctactgcttgaaagggaactaaaacaggtagtgggttttttgtttgctttgttttgttttgctttttaatatggtgcatcgtggggtatgtgggtaggtgtggtattttggaaataaggaaatctgtcctactactattaaactgctttgctcctcttacctcgagttcttcccaagatgccttctctacttttcagtagatccttggcaacctaaatttctagtaggaaataaatgctcaactcttcagagtgtccaacaagtgcatatgtgaatctggagccttcttggtgaggtgaaaagtgggtatctggatccgagcatggctggtttccctcgaacaaatgacagatcacagagaaagtgcagaaagggaggactccttctttcttctgtgtgatgcaggattaagggtgattggctatgctccctcccaatcaggaccttcttactctgctaattaaaaatgatttcagacaggtactttatccacagcctgtttaaaggagtggtcaaaattggatgcatatcagaaaccctaaggagctcttaaaaatgcagattactggctgggcatggtggctcatgcctgtaatcccagcagtttgggaggccaaggcaagcggatcacgtggtcaggagatctagaccattctggccaacatggtgaaaccctgtctctactaaaaatacaaaaattaaccaggcgtggtgatgtgtgcctgtaatctcagctactcaggaggctgaggcaggagaatgacttgaacccaggaggtggaggttgcagtgagccgagatcctgccactgcactctggcctgagtgacagagcgagactgtgtcacaaaaaaaaattcaggtaactgggacttttctccagaaattctgattagctatgcctgaagtggaacccagaaatctctttttaaacttcccaggaaattctgatactcagctaagtttaagaatcactgagtcaaggaatcaagaaattgatgaccattggttctaacagattgagagcattctggcatgaatgttccctgaaccactaaataccaaatacctcgggggcttatgggccatggccatcaaaaagaaccttagtcgtaggccgggcgcggtggctcacgcctgtaatcccagcactttgggaggctgaggcgggggaattaccttaggtcaggaattcgagactagtctgaccaacatggtgaaacccggtctatactaaaaatacgaaaattagctgggcgtgatggcgtgcacctgtaatcccagctacctgggaggctgaggcaggaaaatcgcttgaacctgggaggtggcagtgagctgagctcacaccactgcactccagcctggacaacagggtgagactctgtctcaaaaagaaaaaaaaaaaaaaaccttagtctttttgttaccagtggtaaaaaaaaaaaaaaaaaaaaaaaggtcccaggtactcagaatccctgctcagtaatacagcctgtggttttgaaatattaatcactaaaaattatcacatgggatttctgttctgccaaccacttgaacttgtttggtagccatttttcacttgaggatccaaaataagaatgtgttgtatacagttacataatgaacttgccctcaattttgatcagtgtgattgtcagtttaatttgcaaattgttcttatcacactaataacctgagttactaaagatgaaaagtgcacaaagactttatggagagctgctatttcttttttttttttttttccttttgtaatcgacagggcatgctactgggcatagagcatatatttaataaacatttgctgcttactcattgcatttcccttgaattctggattctagccactctaacactttactttttctttggttttagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacacaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtctttggtatctctattaatcatgcagcctccctgaagcgccctatctcagtattccagaaagctgctgtgtagcattagtttggcatattcctacactgagaactcgacaggatcctccaggtttaagccctcttgttaactcctgcctctgaatcaaagatgcattaagcaaaaacagtgcctgtcacagcacgcatgcaatgttatttgaatgaatctgaaagttgggcacaaactgccatagcctcatttccctacgtcgggagaggaaaactccatcaaaaaacgaaagccaggggcccaggatagccaactaatcgacccagtcaactaactgacccagtgcacaactctggtagctcagaaaacgcgggctaatttggaagtggacaggggcggagctgtggggccagcacggaatggatcacgtggtctgaagtaacttccttttctcctttcttttctttttggagtaacatctcaacggcacctcggctctgggctgtaagccctgcgatctcaaggcgcaaggctgggcgcaacggcagggttgcggggttacgggattgcggggtccggggagtggaacccgccgactccgggaacgaagcaccggcgccaaggtgtgggaggcggcggggtggagttggacgcctgcctcgcgccgacgcagtgcactcacgggggcggtcccagaggcagctagctgtggttccggttccgtcgcggagacacgtgaaggtcggtgcggagttcgtctctgcaagcttggtcgccctgggatggattcctcctcctcttcctccgcggcgggtttgggtgcagtggacccgcagttgcagcatttcatcgaggtagagactcaaaagcagcgcttccagcagctggtgcaccagatgactgaactttgttgggtgaggagcctggggctgggacctgaacactgtacctactttccctctgtccttgtaccgcgggactcgcgacaacgtcggggattcggggtggggggcgggcacctggcagcaacccttgattttctcaggttcctgtggcctagccggatgggagaagggtgactccgcttctctggggactgtcattccggacctcggctttgttggtgtagaggactgggtatcaaagaagacttatgccactggacacccagcactttcaggcacccgaggttgaagctgcctagtgctggtcaccaagactgatcggagcccccagtactgggattttatttttggcagcccgagtcccagagagtcagtgaatcagtgaatctgctattcctggactcctcgggatttaccttcattacccagttctaaccctctccgctgaaaaatgagtggctccagcccagtaactataaaagtggtgtaatctcttccaacgtacatacttatttgctttcttgttggattgttgtgtaataccaagccgttttgggtctgaaggttgaggaattgagcctgccctgtgaggggactttggcaaaagggtggaaggtatttgcagcttgccaacaacgtgttctgcttgccaaggacagatctcccttaatgtacacaattcacagaattcagaggccaaggataattttccttggaattagagggtctgaggcttgtgtacatggcagagaataatgaacgaaatttttgaaccacttaacttgaactatatacagtcattggtttccataggccctttcccataaacttacagtattgctggactatgacacctaccagatgcttacttaactctggtctgccttggaccagagtgctttgattcttttttaaaaatatctgtgattcgttactttggggctaggagggcgtgtggttaagtactattgcaagaatctgtaagctgcccggcgcggtggctcatgcctgtaatcccagcactttgggaggcgggtggatcacttgaggtcaggagttcgagaccagtctgggcaacacggcgaagc

SEQ ID NO: 11752 - DNA, 36538 bp, Human
  misc_feature (1)...(36538): n = A,T,C or G
gaatcgtgtagtccacttctctgtgctcgctggacattcaggggtgggtgtggggatgtgcagatagttgacctccaggcctggttggggattggagaatatgaggaggacagttcattcgcagtagactaacaacaatgtcaggacccgaggctggctaggagacatcgtcttgaatccagtttaacttttctgagacgtgatcttctcggacaaatgaaagcaaggcggtcccgaagcagcaaagagagagaaagattggcctctggctagtgggactgggccaggtagatacctcaagccccatggggaggagatgaaggtctaagttgcaagggttaaatgagcactgtggttacagcaggtaagaagtggagtccagaaaagatgcatgagaaagggcaaggagacccttttgtctaaggtgtacccagaaagcccaaagtgtgagagagtgggcaggcgggcattcacagaagcaagtgcccatccaggctctgactgcacctcgcccacttttaggtctctccgaggttgcagagagagaaggcaatgggccaggggtccctggtgtgggctcctaacagggaggctaagtcttatggatgcaactttctaacctttagattatgaatggagagctacatcccatggggtggcagatgaagatgtgcaagaagaagacactaacaactgaattgcagattgaggagatgagattatggtgacagaatccatcttcggtgtatgtgcatgaagaaataagccaaatctacatctataaaaccgcgggaaggaatgagataataatcagttgcaggtctgcttagattttaatcgtttagtgtagttcgtggcagggtctgataccctatttcaatagtggagagaattagaaagcattttcttttttcatatctactattattggttatataaaagaagtatcaaatggtttctgctttcatggaatatactgtccagtcgcaaaggaaagaagatggagagatgattaaaaaaaaaaaaaagaacaaacagcttccattattctagcaatgcccacacacccctattatttgagcagagaaaacgctgacaggggactggccaggtaaggaggaacagaccacgtggccattatgctcttgccttcccacctgaaacttctgtctccttatggctctccctgagtaatacatatatttatatatgactacgtatctcttactgtggttccaacttggatgcaaacctctccccttggtctccttaacacaactatataaggctgcatttatccaaatgatttaacatgagggattccaggtcttggagactcagtcccatcttgcattctgtcttgaaggtatttccagtccctccccactacccacacaaaaaaagtaaaatattctaggcatattcctggccagcttccttcctgctccctataggtcttcttatacaaggattctgctacttctcactagttaaggccattgtcccagtctccttgccaaagaggtccagggcacaaaaaaagtttaagaacttctggactttaaatacatacttggcgggggggttctctaattctgcaggggcttaacccccaaataaaatgatcaggcaagacacttatcccattttgaagctggggtccccaggaataattgtaggtacttcggtggtacctgcaggattgaaagaaggtaccaaagcttcacactgatccccacaaatggagagatggctccaaaacacaacttaatcaagtgttccttttattttattgggatatattagatcaaagttaaaggtctatgaaaagattcaattgagaaagggaagctcaaagtacaagagaggggaagattaattaatattgaatgtaaattcctaaaaccacctggagggatgggagcagagctcagggagggggatgagactgtacaggaggagcccagctcttcttccagcagcagggaagacggggcagatgccagtgggctgcatgtttggtgtcgggagaatgagggattcccatctgacggcatctactttctctgacaagaaggaggcaagatcatttattgagagtcagaatgagagagatagagaaaaaaataaaactcactttaaagtgcaaatatcaatatacaattgatttaaagaatagagttttcagtctattcttccaaacctctaagaaagatattcttcttgcattgcagttgagagaactggggctgataattcaattaacttccttttccctaagatttcccagttggaaagagaaaaagctagcacttttttgtttggcattttgttttgttttgtttttgagacagggtctcacgcttacccagccggagagcaatggcatgatcaaagctcactgcagcctcgagctcctgggctcaagtgatcctcctgcctctgcctcccaagcagatggaactacagacatgtgccccaaccctcggctaattttttgtatgtgcctattttagtagaggtgggatttcaccatgttgtccaggctggtctagaactcctggcctcaagagatccacccgccttggtctcccaaaaggttaggattacaggcgtgagccaccacgcctggcttactaattttttaatttttatttttgtagatgggggtctcactatattgcccaggctgatcttgaactcctggcctcaagcaatcttcctgccgcaggatcccaaagtccttgaattacaggtgtgagccatcgcacctggccaaaaaagccagcatttaaactcagctcctcagagggaaaatctattctggatgttgtagaaagtgctttatttgttcacttaaaaaaactaaagttactcaactcaggacatttgaatggatacacgttctttcacgcttgtctttttttaattaaggtgggaccataaactgaagagaggaatacatctatctacatttctaaattttgaaatgggaaagcaatgatctttcttcagagtgatttgtagcaataagtctttggtgctttcataaaatactgatgataagtgtcttagtccctacttatcaatgtccttgtatggtgttagagtatctatcttcaggcagccctgaagatcagtcagctttggggcactcctagtggttctcaaataccctatttgctaaaggccagaagtgagagtgctgatgctggaaaacattggtaagaatagtcttggggactaggtggaaatcacgagggtcagtaacaaaggtctgtattcttttttttttttttttttgagacagagtctcactctatcacccaggctggagtgcagtggtgagatctcggctcactacaacctccacctcccaagttcaagcaattctactgccttagtctctagagtagctgggactacaggcacccgccaccatgactggctaatttttgtatttttagtacagatggggtttcaccatgttgaccaggctggtgtcgaactcctgacctcaggcgatctgcccgccttggcctcccaaagtactgggattacaggtgtgagccaatgcacctagcctgaggtctgttttctttaaaatgagaatgatttcctaaatattcagtcaacaggaggaccaagagtggggtttaggggcattaggttgctgacaagggaccccattcatacacaggggcagactcagaggcaagtcatggatgagtgcagatgtttgtagtgtgtaagttgtattcccacatagtaggaagtggccatagaatctgtcctagtggtcgatatagttctcccccgacccctacctgccatccccagctggtttcccagagtaatcaacagatgagggtcctggccattgtgctggggcacagcaagtttgctgaggaaggatggctcagccagttagttatagaggatgagagggtccatggcagaagttctgtggtttcagcgttggtggtggggacaaaaagccctcacattaccaatctctgatctgttggacactatgaaagagaccagcacaggacatgctcatttgacttttagacaaggtttgaaatcttgtaaaatattggggatctaaggtgagctcactcccacttttagttagaaaagaaagcttatctctgggcacggtggcccacacctgtaatttcagtactctgggagaccaaggcgggcagatcatgaggtcaggagtttgagaccagcctgaccaatatggtgaaactccgtctctactaaaaatacaaaaattatccgagcatggtggtgtacacctgtaatcccagctactcaggaggctgaggcaggagaatcgcttgaacccgggaggtggaggttgcagtgagccaatatcacgccactatactctagcctgggtaacagagcaagactccatctcaaaaagaaagaaagaaagaaagcttatcggcatgggcaaacgtggcaggcacattctccttagtgtagtccccaggcgcacacctccatgagccaaagccctcctgcatgggcaggtcaatgtccccaaatcacgttctgtaggattcagcagaagagaatgcccagacaactgcttctttggtgactgtcatagagcctatgcttcagatgaccaaggggatgcatttgccctgtgttttctttgggaagcacatttgtgggaaagcctgcaacccctactgcagatttaggggttccatccaaacattctgataagaaaggccaagccagcagatcgcgcctgcatatctgccagagagcctggaagaatgtcagcgctttcctgctgcttcctggtcaggtcccaagcacacacagcacctcagggtgtcctcaccatgaccaggccacaagcagcagcgaccaggcaggatgccaggaccaaggaggcagggcatagagtctgggcaaccatgagtcagaggccaggtgggtagtaaaaaatggagttcataaatcccagagagaagaaccagatgggatttttaaaggtcaagccaatcccagagcactgacaaagagagggaaagatcaaataaagaatacaaggcagttgtttgttccagcctcagtaggcctatctgccagttttatattccttcctccatggagaaccaatgagaaccaggaactggaaggcttgtcctgattgtctccgatgcctgcctgtctagtatttatgaactcaggggagaggggcaacagatgtcatatcacacctctgaagcctccctgtctcccctgctgggaccctttagccctcacctgtatgcacattcctctaggagagagctcctgccttgtgcttacaagccatcctccccagcttctgcctctgaaccacagcctgatggttgaggctctattactacctgtcagacttctctatcaccaggcacagctgacagcctacctctcagattcctggatatattttccttctgagttccccagttcttttcctttgctagcttttgggatatcctgcaacttcagcttggattcctcttacaaacacttgtttggacggagatctgtttcagctacaaagtctaactacctgaaaccttttatcctttcctgcaactgatcctgttcctaaataatgtgtttaatacataatgggtagatgtagctccagttggctatgtctttatttaagtgagccaatcaagtccagagaaaaaacagtgaaggcattttcccgacagtgaaagagtggtggatatatagggcattagttacagatgactgagtgttaaaactggttgaatacttagaaatcaagttccttgctgtacttccacagacaaggaaaattcacctctcagatttttacagtcacacacttagtaagtggctgagttagtaagtggctgaactgtaaccaaaattcaggtcctctaattcttagtctaacattcttttccctatcctaagatgcacccctaaagctatgttacattatttttctatgacttttattataacattaagccctgttgaaataagctcaggcctcataatctttttgcttatggagactgttcaacttcttgcagataaaacgggttaaaaaaatgttttggccgggcgcggtggctcacgcctgtaatcccagcactttgggaggccgaggagggtgaatcacctgaggtcaggagttcgagacctgcctggccaacacggtgaaaccccgtctctactaaaaatacaaaaattacccggacatggtggtgggcacctgtagtcctagctactcgggaggctgaggcaggagaattgcttgaacccaggaggtggaggttgcagtgagctgagatcgcaccactgcactacagcctgggcgacagagcgagaatccgtctcaaaaaaaaaaaaaaaagttttaagcgagtagatctcctcataagcattcttaccaaccacaataaaattaaaagaaaaaaaaagaccattgttctttctaacttaggagttcagagctcatttaagaatgggtacttaatcctagtgtataggttcagaccaccgtttggttaaggttttgtgatggtgataagctaatagggacaaggcattgctctcctgggtgggggtccacttgaaagctgttcactcactgaatcaatcaatcacaattatcctgccagggcacccacacaggcaggaaggtccaaaggacactggaaattttgaacgccaggtgctgggtgtttctctctttaacttaaagaagaatttcctttccaacctctttgttcatgtatatgcatgaggtggctagtggtagtcaagcctgaattttattactgatggtggaaaactgtgttgggggcagggccaaggaatgcaagcaatgtcttccttctaaggtgggagctggaatttgccccttgatctttctcttcctggagctctagtttctctcacagccaaaatttttgaaagagctgccggcactcatcttctccatttccttacttctctgcactcctcaacttacccaatctggcatcttcactctactgaagcagctcacacggggggctcccctgtcagaggcaattgaaccagagcaactccatcttgaataggagctgggtaaaacaaggctaagacctgctgggctgtgttcccagacggttatggcattctaagtcacaggatgagataaaaagttagcacaagacataggtcataaagatcttgctgataaaacaggttgcagtannnnnnnnnnnnnnnnnnnnnnnnnnnnnnnnnnnnnnnnnnnnnnnttcactgctaccctcccaccagcgccaacaaatgccatggcgacctcaggaaattaccttatggtctaaaatggggaggtatgaataacctaccccttgtttagcatataatttaaaaaaatacacacacatgaaaatgggcaaccagcagccctcagggctgctctgtgtgtgtagtagccattctttattcctttattttcctaataaacttgcttttactttcctctatggactcgccctgagttccttcttgtgcgagatccaagaaccctctcttggggtctggattgggacttctttccagtaacacccttagcctccatgttaacagattttgttcatttctaaccttaagtggcacatcaggggcatttcataccctcgtgagggactcatggttactccctcattcccaaacactctttcttggttctcctcttgactttccggctgctccttctttgtctttttttgttagttttttccattattcattcattcattccatattacaggtatttaaggagcacctacctactctatgtcagtacctctctaggttctacgatccaaaactcctgctgtcacggagcttatagtctagtgagaagtggtggggcagaaacagcaatacaacaattaagagactgaattgtttggtgggggagtgccaaaacccaggatggaatgatatatttaaggtgataattactatgaagaaaaattaaggaagggccaggcgtggtggctcatgcctgtaatcccagcactttgggaggctgatgtgagaggattgcttgagctcaggtgttcaagaccagcctgggcaacatatggagaccttgtctttacaaaaagaaaaagaaaattagccaggcctggtggcacatgcctgtggtcccagctacttgagaagctgagatgagaggattgcttgggcctgggaggtagaggctgcagtgggccatgattatgccattgcactccagcctgggcaacaccgcaagaccctgtctcaaaaaaaaaaaaaaaaaaaagaaaagaaaaaaagaaaggagaggtggataataatgaaagggctggtatatgtcattctaaactggatggtcatgggaggcctcactgagaggtcagcatgtgaggaaggctatgatggagataatggggtgatccatacagatgtctgtggaagaaccttcccagcagagaaactagcaaatgcaaggccctgagatgggaatgtgccttacacattggaggaacagtaacaaggccattgtggctgaggcaaaatgattgctgggagatgaagccagagagcatgtgggattagtttgatttgatgtaggtagagcctaggaaaggttttttttcaatttgtttaattttctccttgcaacaggaagcaaggcatcagctatgcatgaggatgtggaaggagatgtggagagagaggagaaggtctagaagccttctgagagagtcagagtgggagagtggatggaaaaacgagactggtatgtttatcaggacgtagaaaggtcagatggcatctgcagctcacagccatggagtttacaatgagatctgtcagaagggctgtatgtttttctgtagcgccacccagctgtgtgggtgcaggcatggagttggtagaattggactcagcccaggctggggttttgccaagtgagcaccacagggtgagaaagaggcacaggaagttgagacagatgtaagggagtgactgtaatgattgtccaggaaatgtgagctggtatggacgtgaatggcaagttccagtgggccaagggattgtcgaagcacaaaaagagaatgactagaaaaatagaaggagctggttggagaaagtgtggcttaaaattaggattgtacagagatggctcagggtctatttagaacttgctatgcaatgtgggagccaccagcaatgtgtaacctttgagcacctgcaatgggactagcgtgaattgagacatgctgtaagtgtaaaatacacaccaaattcccatgacttagtgccaaaaaagtaaaatacctcattaataatttttaaggcctggcacagtggctcatgcctgtaatcccagcactttgggaggctgagacaggcggatcatctgagatcagtagttcgagaccagcctcgccgacatggtgaaacctcgtctctactaaaaatacaaaaattaaccaggtgtcgtggtgggcacctgtaatcccagctacttgggaggctgaggcaggagaatcgcttgaacccgggaggcggaggttgcagttgagccgacattgtgccactgcactccagcctgggcaacaagagtaaaactccatgtcaaaaacattaaaaaataataataataaataaataaataaataattttaaaaatagtggttacaccattagtggttacatgtttgggtatataggcttactcatttattttttttctttttattcatttatttttactcttggccaggcaccgtggctcacgtctgtaatgtcagcactttgggaagctgaggcaggtggatcacttgaggtcaggagtgccagaccagcctgaccaacatggtgaaaccccatctctactaaaaatacaaaaattagtcaggtgtggtggtgcgcacctgtaatcccagctactcaggaggctgaggcaggagaatcgcttgaactggaaggcagaggttgtagtgagctgagatcacaccactgcactccagcctgggtgacagagcaagagaaagaaatgagggtgtgtgacccagggcaacagatgactatataggatgtgcagtagttgtgtagtttaatcacgtgacattcaaaactgggggattttaggaaggagggagggagaattgtctggatatagcaatgagagttcaaagagatatctgttccacattcagggctatggggaaaacattgtctgccacctggtggggggcgctgaggcggtgtgtcctcagggatgatccaggttagaataagaaggagagaggatgctcaaaaaagaggaatgcttgctgaaaagggcctacatgctctgaaggcaccctggactggttttcaggagttgagccagggaccaaggtgtagcaggagctaggaatttagggcttctttccataagtgacattctggggttaataaaagggacttaatacaggacttaataaaattagctctggtggtctccaggcgagcaactgtgggcaaggcactcctgcgctcacagtgtaggcaaagtgggaggagtaagcatcctttctttactgctggcagagacacagaggcctggggaagagcagatgtgccttgcatctgagtgagggtgacttttactcagaaagtgcatacctccctcttccacctaaccataaaatgctagaatccagcaaagcccatatcctagccctctcgactgttcatgcaatatttgataggtgattttttttttcagccaataatggcttcaaattgctatttggaggtagatgacttataaatgtggatcttcagtataattttcttttctctgccttggacctggatatcctactgcccactgtgcgcctactcgttctcagtacgtccagaatgaaacacacaatctcactcccagacctgtacttttcagtggagagtgccacgctccacataggtaccaaccagaagctgggatgggcctgtgatgtctctttctccctttgtcccattctttctgtggacgagttcatgtcctaaaaagctctctactctatccacttttgtccatttccacaaatctcctccctttcacctcgagctctaccagaaccttttaattgtccttcacacatctgcattggcctctcctgtgactctccacactgcccctaaggcgacactttcaaaattcccaagtctcttcacgcccctcttttcaatcgaaaactctgcggtagttccccattgctctcaggatcaagttgaaaccctttcacatgctctgcaacctctctgcacccacctgtccagcctttcctcaccctgtacctccagtgaggaatctctgtcttgacactccagccacacctacctgccttggggtctctagtgcgcccacagctgtcacagggctttgcaaacacttctccttttgcatggaatattcctctccttccactttgcatacttaacttctgcttaccgttcagatctctgcttgggcttccctctcctgagctccccaaccaggtcacatctcccatgtacaggctctaccggatgcatcctattcctttctcttgaggttcctgtaacagttgcagttttgcatttgtctgtcattatttaattagtgtttatctcccataggagaccctccaaaggcctgaactcaccaagggctgagatcatgcctgtctttgctcattattatgtccccagcacctaacaaactgtcctgcacatagtaggtgcccagtaaatgtttgctgaataaatgaatgaataattcgtgatgcaataaaagtccttaagctttaccaaatacagggcctgccttgatctagagtgagctttcaatggttctggaactcagtttcagtcagcaaatgtacacagcaaatgcactgtgctgggcctgccctactccactattcttaggcacactggaacaactttgctggaaccagggagctagctgaatggcacgactgtcttctggtagcatctcacgcttgggtacaaaggcctgtctactggcttgctcaggcatgttgagagtctgagtctgctgttggtagacctgaataggtccacctgttccctttttctgagacagtgtccattggctacatgggtcacatctctgggggtggcataaataactacagacagggtggcaggaagggcagcctaaggaagcttgagcaagctctgagggtgactcagaagcacccacttcctgtgtcagttcagcctagtgggtttctttatatgaagcccaccttattaaaggaagtggaggtgggggagcaactagagacaactagtacttgtcacctcaagcaagatgggttatctacctacattcaacctccactctctgcaatgtttactcctgccagtgacttagtcggctattttcagtgacaaacactccagcttctaggccaggctctctgattttggcttcctctgggtgcacagagaatgaaggcagctgatgctccactagcggctgcctcggtgccagcaacctggctgtgctgctgttggtgccttgggtctcttttcctgtctgcccttctcagctcccttggttgctgactcctcgccatctgaccatctgcctcgctctgccccttccacccaccacacatttctggctgctgatgcttgcagtgcctttgggtgcccatctggcccagcccttgggatgaggggactcctgccttctcctgcttctctgacctctgctccctggatgccttatgtagattctggttccctggtcctggaatcctcactgctgcttctgatccggtgggataataatgaggttacatggtgagaaggccacccaggtattgtaattagtagccacaccaagccagctctattgggtgggtgattagaaaatttttttttctaatcttaacacttattatactaaaactatctacttaagtattttccccccagatggagagtttcttgagggcaagaactgagtttatttttctttatatccagagtgcctagaatatagaaattaactggtaaatgttggctgaactgaggttgggaatgggagggaaagtgtataggggatgatgctctgatgtcagcttcctgggctgaccctgaagaaagaaggaaacgtgggcatttgtggttgtcagtcccacccctctcttgggggagtggcccttggacagggcaggaggctgctcaaccttggccttgactgcaaaggtctctgggtcttgctgtgtgcttcacccagacctcatcctgatgcgcgcccaacccatccatggttcatcatccaccgtgtctgcagttccctcagggagagattcttttgtactggcatgcaggccagtgggatgagaggggcagtaaatctgggagcaagtgggaagctgcaggccgagtgcacacagtactcagcgcaagggaggtgctccaatatcaggaaaaagatacaacggctctttcatttctctcctttcttttttcagattataaagtaatacatgttcacagggacaaaatacaaaagtataaaagccttctgtcctcctcaatctactccctaacattaactactgttaacaattcttttttatttgtttatttttttgacacacagtcgcattcctcgcccaggatggagtgcagtggcacgatctcgatctcggctcactgcaacctccacctcctggttcaagcaattctcgtagctgggattacaggcgcacaccaccaacccggcttatgtttgtattttttctagagacggggtttctccatgttggccatgcctagtcttgaactcccggcctcaagtgatcctcccacctcagcctcccaaggtggtgagattacaggcatgagccactgcgcctggctgtgctgttaacaattcttgacatcttctggaaatgtgctattttacaaaagcacgtatacatatagcttgcatatacaaaatgtgtgtatgtgttcacatgcagatagatatataaacagacagaatttgatggtgtcatgagacagaaagagaaaatggtagcccacaggtataaagtaggggtgttggggtgaaggcagacttgaaaggggctgttgatggaccaggtaggagggcctgaggagaagtgatggaatacaaggatggaagcaaggatggggcaggagagtcttaatatttgtgttgcaaaaaaattttgcagtttaggaggtgagaaatccaacatccagttagcctcagtttccttaactaaaaaatgggataatgatgtatattcctcacaggtttatagtgatgattagaaggggcgaatatatatataaacaaacatacatatatgtttgtttgttttttggacagagtctcgatctgtcacccaggctggtatgcagtggtgcgattttggctcactgcaacctccgcctcccaggttcaagtgattctcccatcttagcctcctgagtagctgagactacaggcacgtgccaccacgcccagctaatttttgtatttttagtagagatggggtttcactatatcttggccaggttggtcttgaactcctgacctcaggtgatccacccaccttggcctcccaaagtgctgggattacaggcgtgagccactgtgcctggccagggctaatatatttaaagtgcttagcattgcacctcaaacaatattctaagcattctctcagcgtgtgctgctattatagttgttgatgttattagggtgctgctattgttgctgttttcagaatgcttcacgtggtccctggcccgtgagtgaacctctatccatctgcagttggcatatggaaagaacctcctggtcacatttctctttccattttagaaatcattcttttgttgtgacactgtcttttcattttccttccctgactgctcttaacttcctactttatgctgtgcactcttgaagaaaactttctggtacctgatggttataaatccttggaggcgcgtgaagatgttttaggtagtaaagggcagtggccattttctcactttgtctccctggcctggtcttaagctgttgggcattctttagtcaggaacatcttatttgctgtacttcacacatactgcctaaggatatcaattagaattgcttacttaagaaaaatgcccagcaatcgttaaggccactcttgttcatttcctgcattttttttttttttttttgagatggagtctcactctgttgcccaggctggagtgcagtggcgtgatcttggctcactgcaacttccgcctcctgggttcaagcgattcttctcctgcttcagcctccccagtagctgggactacacgctcccgccacctcaccaggctaatttttgtatttttagtagagactgggtttcaccacgttggtcaggcttgtctcaaacttccgacctcaagtgatctgcctgccttggcctccaaagtgctgggattacaggcgtgagccactgcacccagcccattgtcttcattttaagagcactgactctgctgctcctcttgagacatcttgggcagtgattctgttcttctgggatactctgggtgtttctacttgtatttagaatggctggcttaaaagtctttgtttgaatattccgcattctgaatgctcttagttgtcagtaaaactatgcctgcctacgcactcttctatttctgatttaaaaataggttcagctgcctaacaattacacatactctattttgcacgcgcacattacttaaggagacatttagagggtagatagcttttattcctatgagttatcttgaaatcatcttcttaactatctttttttccccaaaggggccatattttgaaggatttgtgatgagacttttggtctgtgaagcccaagacacaatctccaacatgcacaggaaatccagtatcaaatttctaacatgtcttcagagacaggcccagggctggcttgagcgtgtcagagaggtgtgcactgcgtactacccatcatacatggccacacatgcctgtggctgtgagaaatactggtggtgacaaagacaatgagatgccagagaaaaagatcagtggggtttgcaaaagtgattaagatgtcgtcctaggtataattaaagacttaataaggttgaaggaaagagaggacattgcacataccgaggcccctgagagatctgcctggcaacccagaaagggacatatgggggaaaacgccttagtgtaaccaggtcagaattttcattctgggcagaactggaatttgaataataatactgagtcatatagagcatacagctatgacatttcatttatttctctatataatgcaataaagtagatggattaaccgtgacgtttacagatggagcaggggagaatgaagaggcgtcagtttgggcatcaggctggatcttcacactctgacctcactctgctctatcctgcccagtgttgcttcacctgatatcaggggtgcaaggcaaccagatctgacaccagtttcagtttagatcctgcctttacctgggtgtgacccgggtccatctcttcagctcggcctctgctttctcttcataaacttttggggttagtcctcggatgatctctaaaacatggcccaggtgctccttgccagtagagtgtagccggatttggagggactggacactcagtgtgaacaagacgaaggcctcaggaggcagtaaaagctgacaagaggagagaaaatgaagcgcctacgggtgcatactggactagcgggcgaaaggccatgactccttagtttggagaaagaactggggccgagattggggaagtttcccagtgcaattaaaaaaaaaaaaaaaaaagaactagaagaattacccaggtctggcttctttcgtgtagcctggggctgagtcgcaggctgagaaatccagtctggccagtagggggctccaccaagcgcagtctcagaatgcccaagagctccaccgtcgcccggggtctccaccaagcgcagtctcagaatgcccaagagccccaccgtcgcccggggtctccaagaggagtgggtcgtggtgggcgttgaagggccgtaaaagacgagcagcccgcgtccgcgtccgtcctcccgggtctccagtccgcaggcggccgccgcctcggccccgccctcccacctccattcccggccccgcggacccgaacggtccctctcgcaaccgatctgctggctggggcgctggggatgcgaattcctagaagccttaagaggctgcccagcgttggaagttcgtatccccaagaatgctggaggttccggctcacacaccccctccgggcacagagtcagctggggggtgctgggagggagaacgccccgctcctcaccccccatccccgtgcaccctggagcccagctccatacgttcggccaccccaggcggactcggggtggccgggtagcgggtggtggcaggaggggaccgggtaacggcaggcccgagaggaggtcgctgggccgggccggaggcgcacaggggctgcgtggctacctcggcggcacccgccccacctccgccggctaagcccggagggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggtccgcccttccccgctctccccgccccctctccgggccgctccttgtatggtctgggcgccgctctctccccgccccctctcttctccctccctcctccttccgtgtgtccctccccgcccggctggaggctgctccggaccgggacgcagagtctgcggacccggcgccgaggcggccacccgagacgcggcgcgcacgctccggcctgcggtgaggcgcggggagcggcagggcggccccacggggagggggcgcggggcgccgggagggggcgagtgggggtcaccaaggggagctgggaccgcctggggctcctgagcccggctccgcgctgcgtaacccggcgacccaccccagcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaaggtatgcggcggggcttggggaatgtaccccggcaggagccggggtggggggcagtggtttcgggaatttggggatgtctggaaaggttgttgccgagggggctgggcgcagccaccctgtcccgagcagatgttcttacctcatcgtggagctcgtggctgggagccagggctcctgggaccgttccaagtcccccgcctgggagtgggagtcgggaatgtggggcacgaatcttcccctccgggtccgttttccgaagtgtaacgggagctgcaccactcctcggcagtgcgcccggcctttcctgacctggtactcccagggcgccctgcgcccctcctttgcttccccacacgctctgggacccctgagagagttcttgggttaggggttagagcggttaactgaggggagcttgggtgaggggtagagggaccccggccgacgtctttctccttcctaccccagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacaggtacggaggcctgggaggggcggctgcactggacacccccaaggagaggagaagagggccctttcttcttacctcccctgcacctctgccttgggggtggggggatagaggcatggaataggtgctctgacctctgaccctctagcccagggagaaggtgagcagtattgatttggagatcgactctctgtcctcactgctggatgacatgaccaagaatgatcctttcaaagcccgggtaagggaccggagagtaggaaaagcaaggctcagggccagagagactgggcatagaactaaggaggatggtgtcctcctgactgcatctctcttccctctcccaccccttgcaggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgagggatggtgataggacaaggcttggtaccagggcactggggcggggctgggtcaggagccagagcataagcataaggtgattggagagtcagggtggacacgggggttgcggggtggcgggataggaattttcatcctctggggttagcctggtggaacaatggtaggaaaatgctcctctggaggagaggcctggctgggtgtggggctgggtggggcctggctgggacggcgcagagagcatgggctctgaattaggaggatctggtggacctttccttgtgcctttaccccagaaagttaaagggagggatgagatcaccagttccaccttggtttttcccattcttgggtcttgagttaatctccctgctcctctgagcactctttctgcctgagggcttggaggtaagagacagccccagtaaacactggttgagccagcatccaccacgtgccaggcactgtgctctgtgcccaggagggtaggacatgggagggaagagatctctgcaagaagctcagccttcaggtgtcagatggacctggaatggaattcttggctcagcttctcccaagtccttagactgggcaagttaggtgaaccctgagcctcagtttctcaatctttaacattctctactccatacagtggttgtgaagattgggtgagctaatacctagagagtgttgggttctgtatctagtacaggaatgctcaaaatagaaaagctgtaattacaaaatggttcttgccttctagttcaggaaataagatcgtccaatttctggtgacgaagatgaccctgatggtcatctagtccaagcatccagagtccactgatagtgttgatgtctacctacactcggacacagcataggaagaaatgccaagggccagtgagctttgcagaatcctgtgagtcacaggcactcagaccagggagtcaactcggggagtcaaattaggaaaggcttcgaaggatgggcaggacgtaagaataccagagaggagagggatgtttggagaacagaaagtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcgagtgggagagaacaccgtggcaggtgtgtgggaggctcccttgctttgggagagtgactggtgaggcaggaaattccctttgatgagggccagtcatggtgtctcactcttaggcccttctggtgagcttcctccacctggagatgcagggcagagaagtctgcttccttgctgcccaacctggcttatgcgtgcgcacaccggggatgaaagccctggctaactcggctggccctttctgccccttccaggcagtacgccccgaggtgctccgtctgctctgagcccatcatgcctgagcctggccgagatgagactgtgcgagtggtcgccctggacaagaacttccacatgaagtgttacaagtgtgaggtcagccatccctctggactccttgggcaggttctgaccaggaggtggcgggagatgctgcttactaactgggaggtggaaagcaccagcattcaggaaacagggctgtgattttgagggtggctcatggtggcaccccatctgtcctgccagaatgcttcctgccactgcaggaaatggggctgtggggcttctgaggtcactttgagtcatggataagccaagaaatgggacaagccaataggagagaagaagggcatggtgttttaccgtggtaggggatggggaaacaggagctgagagaagaggtcttcgaatggaggtgagccaacctctattttattagggtggtggtgggcaggggagcaagcaccttgggagcagctctacccactgcttgccctcttgcaggaaggtcctagtgggtgactggaagtaggatagggatggggagttgggtgtggctggaaaaagcgatgacaccagctctgagccatgaagcatctttctaattccaagatggagctggatggggtggggtagggtggagcagagcaggggccttccggtccagtgcccctcacccttccttcttcccaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaattctcagtagtcagctcttttgtagtgcctgcagccctcatgggtgggatggaggcagaaaatcagttcctgtttatttacaaaaatatatatatgtgtatgtatgtatatatattaacccctcagctccctcccatgatcatccttttacttctacccccacctcccttttaaaacaaagaggttttctggggtgcagagcagggttctcctgaaagtgggcagaagcagcaccgatagcctagtctggcaggttgtgggaaggggcgcagggagtgaccatgagcgaccttggccccgtccttgctccttgcaccctgattgggcatggggtgagaggagggatcagtccttgaatccctgaatactgcaaagaatgcgcttctggtgcccgggcagtgtgattcccatctgcgtcaggtccctgtgggcaaggaagggtgggggcatgagtccggaggctccacccccgcagccctcccctgcccagacagctccagctccttactcagcggtcagctccagcacacactccatggtgtccagcccagccgagtggaagtgcaggatgtagcgtttcatgcgtatggactcgagccactcagagacggttcgatacgggatcccatctgagccactcaggctgggcaggcgaagagtcaccctgtgggacatgggcatgtcagtcacagcgggtacatgggctgatctggttggccttggcctctgagcatcagcagccagcactgaagttcggtgtctgggcacagagatcatctagactgtggattgaccccaccattatctctgagcccacttcctggcctgtttcctggtgtgctcacaacagtggactggctgacagtcctgctatgtcgacaggcctataggaagggactgtcctgggaagccccaacagaaggggatcaccagccggtctcctgctggagtggccggttctgggcacctgactgagggctggttaagacatggaagtctcctgtctgagaggaagctgaaagtaggagaacagaggcctggcacctgggcgtggtcctgcctttttccatagtggctgcttgagttccgggagcagtccttcctcaccaccttcagcttcggctgttattcttgcactctgacacccacaatacaatgagtgttcctgtactaaagctcgccagagccaaaaaccattagcaaagtaaatctgctgggggaaaaaatatccagcattccagaaagattagcacacgcagtctccagtgtatgagggagttgcgctccaaaagatagtttcaaaagttggaacttagagcatgttttctcccagaaacaaggttatatatggtggttggatacagaggccagttggccaggctggctacccaataaagcacttgaagaacagccttgcctgcttccccaacctgagcgctcccccacccccccatcagttcattctctacactcaggccatatttttggtaaaatgcagctctgaccatgtccccccatcctgtggacagcttttaagaattggttctccaggccaggcgaggtggcccacgcctgtaatcccagcactttgggaggccgaggtgggcggatcatgaggtcaggagttcgagaccagcttggccaacatggtgaaaccccgtttctactaaaaatacaaaaattagccgggcatggtggtatgtgcctgtaatcccagctactcaggaggccgagacaggagaatcacttgaaccctggaggtggaggctgcagtgagctgagattgcgctgcgttactccagcctgggcgacagagcaagactccgtctcggggtggaaaaaaaaacaacaactctgcactcatggtaaaatccaaacttctcaacagggctggtcctctttgtgttgactggttgtctctccagcctcatggctgctattcctaaacacaatgccgcagccatcctgcactatctgcaacctaccagccctcagctccccacagactagccatgtgatccagaagccttcccaaaccctgcaaggctgctgctacctaccccaccccagcctggctgcccaagctccctggagcttgggtaataagtgcagctgtatctccaatgtccagcaaacagcttgcaccagtaggtcctccaaaacttcatgaatggatgaccctttccttcacatgcagaaatatttctatggggaaggggatgcatcccaagaatgggccacagtacaacacagtgggattggcaaggatggctccgggagtgtcttaggtgaggctgcctgagaagagaaaagatgggccccccacccccaagcccaggtgaagtgagggaactggggcccagccataactgattttctgcaaatatgcataatctaaagctgacctcttggactctccccaagggcacgtcttgcctcatacactggacttggtccagagctccccaggcccagcgctcaaagaagattggctgaatgcccatttccactctcctagcgctgcctctgggttccctagtccttcccctgcatggttacctggggtcaaagttggcaatggtccgcagggagtgggggttggcaagcagttgctccagatgtgcctgaagcttctggaagtgtggccggcgggcacggtcatatgcccagcagttcttcatgagctcatacagaggggcagggcagtccacaggagggggcaaccggtacccatcctcaatgctcttcataacctgcacggcgggacaggaggatgctctagagtagcaagctaacctggaggcccatgagaaaccgacggtcacacaagataattgcagtggagatcctaggatgggaggaggtgggaggaccagggtgggacgatcacagtgggaggatcagggtgggaggagtaaagagagcagggcatgaggtgaagaaccagaggagccaggagtacagaaaaactgaaggtcatgaataaataaagatatttgcaggaaaaggccatgggaggaccttgggaggaaataagaggtgtgaattggagacaagatgaggaagaatattctgggctcacctcctgattgctcatctccccataaggcttgtccccaaagctcagcacctcccacatcacaatcccaaagctccacacatcgctggctgtggtgaagatccgatgggcaatggcttcaggggctgtccaacggatagggatctttcctccctaagaaggcacatgggtcagggacggaaagttatggtgtccacctgagcacgagtctttctgcttcttttattgtatttttattttattttttttgagacaaagtctcgctctgttgctaggctgcagtgcagtggcgcaatctcggctcactgcaacctccacctcccaggttcaagcgattctcctgcctcagcctcctgagtagctgggactacaggcgcctgccaccatgcccagctaattttttgtatttttagtagagacggggtttcaccatgttcgccaggctggtctcgatctcctgaccttgtgatccacctgcctcggcctcccaaagtgctgggattacaggtgtgagccaccgtgcctggccaagtctttgtgcctatatacatgtgactgtatgaatggcatgttacggggcaatgtgaatgtgcactgggtttgtaccggcctctaacctgggtttcgtatgtgccatcaaagtcatccaggaggcgagtcaggccaaagtcagacaccttgcagcacaggttttgattcaccaagatgtttctggcagccaggtcccggtggacataattgtgattactgaggtagttcatgccagatgctatgccctgcagcatggccactagctgcccagggaccagctggtcctcccgctcctgcagcagggtgagtgggtgagtcaggggatgggccaggtctcctcccagtgcccagggtaccatggtgcatccccctccccagctagtcctctgccctcctcaccctcaggaaggcatccagggctccattctccataaattctgtgatgatcatgatcggctttcctgagacacagacacacatatcacactcagaaccgggcttcctgcccttggccacacatcctccctccacttccagtggtttcacccctctttcctgcatttcccgcccccagctgagggagaccactcatcgtacgctttgtgacgacgccttccagatgcagaatatgcgggtggctaaactggcccatgatagttgcctctcgaaggaagttccaccactggccacctggggatgtgtcttttaaggtcttaatggccacagtcttgcagtcctggctggggagcctcagggtccctcgatacacttccccaaactctcctgggtagaaagaaaacaggctgtggcccgatgcactgcagggctcctccaggggacaggcagcaacccctccagtcctccggcccttttcttttctggagaatcagaagcgtggagtgcccttcctgggacagggcgtgggctgtccttcctggggaaggtcagagtctggagctggagtgcaatgccgtgacctattcaccactgtctcccagtgtttgcacagttcttggctcacaataggcgctcggcaactgcagggtgaatgaaccctgtggagcgggactgggccgtgctcatgaagagcaagctagtgcggcgctagtacccaagtggcagggacgctggctatggccgcctctcttctgtgagctcctctggtcccagcttgcctggctcagctgcacaattggcaaggacaccaccaagctttgttctccactgagatccatttcctctggtgacccaagggaacagggcagcccaaggacactgggcctctgatggggtggaatgccaggctagggagggaatgagtcctacatttgggcatcatcacagaacatctggaccctcagcacagcagcacctctgtggatgaaaacagtgtatttaatgccctttatcagaaactccaaaaccacagaagcaagtgtgtaggagacaggggttgctccagggcacctgatgaggggtttttaacaagaacacaatggttcaaagaggatacagagcagagcagagtgagtacctctggaaactcttggaccagagaagccagctgggctgcccagggaagcgctggaaggaaggggcctgctggtggctctgtgctgccccacatggcggggggcctgctgcggtgcacagcaggactcaccttctcctatgacagtgtccaccatcagccacgctggatcaagctcccgggtaaagtccaaggctccctgtgcagggtcctcgtatgcctggaggtccacataaggcttcagccacagcttgtcctctatgggcagaacatgaggttggggagtaccaacatcagggctcaggagtatgggggtcaggagaagggccagcagcggaccacacacttctccacacctccctgtttcccaaggtgactcctgtttgggctgaggtgggagaaagtctccatttagcaactaggcctttcttctccctgtctatgctccaagctccgctgtcctcactccacaaggtccggggcggtggccaggatccacacccgcagagcatatttgctgcctgagttgcccaatcttctcagcggccagtccccacactgctctggtcagtcacacctcgttcacattcccagacagagccgcgcatggctcccaccccagctgcccggatggacccctcactctcccctttgtgggtcacctaatgaggtgacaagcaagaagctcataagcctcggaggacgtcaatcctcctcccgcctggcctcggcccacagccctggcctccaggatggggagggctgtccagagcccagggtgacaagacagcggcaccagcagtgaacggacactaacagataattgcatcagagccactggggggctaccagtacatagttaattaaccaaagttaattaggtagcaaaacacaagagccctggggacaacaaaccccacatgtgcccccagagttggcctagcaaatgtgtcccttgatcccttcccagtggcatctcccaacacacacacacacgcacacacaggtgtgcacacgcatgtggggacacacgcaggtgcacccgactcacctcgatccacatcggtggcgcggtcacgctgcctctgctgcctctgccgctgggctctcctgtgggggttggggaccagctccttcagggccccaggaccacctcaggggtccgagggactctggctgaatcttccccagaaacgggctgggagtgcaggatgggttttgatactaggggatgggagggtcgttggggctgcagtcaggggcttctgacccagggctggtggttggggagggggcaggagctggcacctggaccggaaaacgagaatcccaagcagcaaggctgcaccaagcagcagcccaaagatgacggctacaatctctcctccagtcaggcccctggacactgtaggcacaaagggatgaggaagtgttgggactcacagtccgtaggaatgaggggggttaaagggcagggccctgggtacacctagggtcagacctttcagtgtgcatcaggtcggtgtctgtcccctacccccggaagaagggagtgtgtgtgcatgtgtgtagaggaagaggaaaagtcactacgtggaacaggagctgagttgcctcagtgaggcaacaggtgtatgtgtgttggggcagagcacaagataccccacctggtgggctggtccgaaactcatgatcaggggagaaagggccaggacccagtggggtcagcattcggactctgacgatgtatgtggtgtcaggctgcagctctgtcagcaagaccctgggttctagaaccatctggtaccgttcttcatcctgtgggttggagttgcattaagtgggcagtgctgagccagacccgggtggatgtgatggacagcatcagagcacatggggaggggctggagagcagaatggttaggacagggttcttcatagacttttgtcctgagaaagccacacagtggacttcgggtggattcctcccaacccacaccccaggctaggaatgttggggtgtgcccgggcatggacactgaagaccatctctcagtagcatcctgacctggttcagcacgtgcagctcataggtcaggttcgccccagggcttcggggccgggaccccgcccaggtcagctctagttgcctcggttctttcttcaccagtctcagagacaggcctgacagtgactctgggggtccagagggataaggttggatatgtaaggaaaaaggaaataaccttagtaacttttctatggcttcctgcccatcagtttgttctgtggtcttaagcccttctgtctccaccaggtccctgtcccagcccctctcagcctctcacctgcatgccccatgctgatgctgactgaggtgctggcatggccagagctgcccagccctgacactccattttgggcttccacattaaaggtgtagttggcataaggttcaaggccattgacatgcactgcaggtgtggtgagcccccgggcccccggcgagaagtgcacgcccaccccacagggctggcagggccccccgtcctgtgctgtgccctgacactgggaacacctcacactgtatctgacatcctggcgtccccccgtatctgctgggggttcccaacgcagggagagctgagtccctgaggcagagaagctcaggtttcggggggccgaggggggacctgtgggagaagaggagccatcagtagaagccgacctcgctgtcacccgagctgctgatccccggcctccaccaccacccaattctcgatgtcctctgaagtcctcttggggagatttgatttctactgggtttgactacatctctgcattcttctagggagagcagggtgccagggcaggggctaaaagtgcctgacaccctggaccatctccaatatctgacaagctctggaaaaatccaaccctgacaaagtctcagcaaagatccagcccctccctccagatggccacgccccaccccctggactcacctgtgcatgccacctgggggccctccccgggagctctgtaatggccgctctcacaggtaca

SEQ ID NO: 11753 - DNA, 40315 bp, Human
aggtcttttgttgttgttgttcctagaacctagaaaacttcaaacattgttgcctagttagaaaaaaatttgaatgtggattgctccctgtaaacccccttctaggaatgaccagtaaccctttcaaattctttcactcccagttacttcaaaaaatcatccaaagtggtctcccaagtgagtgcctttaattagaataaaacaagaggttattatagtttttggttatccacttttacttgcattaacctttttttcttcttttacatttagaaagagtaacctgctttagaatagtcccttttatttacagaagctgctgatggagttaacttctgcagaaattcttccttaaggcaaagcaaaaaaagcggggagggggtggggggaaggaagggaaaaagattctcagggaactacagcccacttgcttctgtttcttagagacagaactgacctaaagatgccccctttgcgatgacttctgggatagagcagcactctaactaggcccccgctgcctcatggggaccttaggcaagtagaggagaggcctgacacacacacacacacacacacacacacgcacacgcgcgcgcgcgcacacacacacacacagcctttcaaacctagggcctggaatgccatcccaagaggctttagaaaaaggcacaggacctttggcctcccacctcagggtcaaagtaccagttcctcctctccctagtagggagtggagggttggatggaggcggccagagaagagggaagttgggtgctggggagagagttaacatccacgttggtgggcgcactgcttggggtgttaccagcgaagactacgaagaccccaagctcgaatcagaagggcctctggatgtgctaggggaggtgcttgggtgtggctgtaagagatgggacagagagtaagcagcaaggtcaagagggaccggggggctcacgggagggttgaagggtccaggctcagggtagaactggtaaatccagacaaggagcccatggagaaggggaggggagactggaaaccatgaaagatcccccaccgcagcctcagaaaggagagactgagaaataagttctcggtctccaggtcggttggagtcgtgtcggagtgccagaccatcccccaaaagaccctctttggaatgagcctcagcaaaggcaagctaggaggtcgaaggacttccccaggtgactcggtctagtctagagttcgcaaagcctatcctccctgtagccgggtgccaagcagcctcgagcctgctccccagcccacctgccaacaaaaggcgccctccgactgcaacccagccctccacagacaggacccgccctttcccgaagtcataagacaaagagagtgcatcactgctgaaacagtgggcgcacacgagccccaaagctagagaaaagctggacggggctgggggcggggtgcaggggtggaggggcggggaggcgggctccggctgcgccacgctatcgagtcttccctccctccttctctgccccctccgctcccgctggagccctccaccctacaagtggcctacagggcacaggtgaggcgggactggacagctcctgctttgatcgccggagatctgcaaattctgcccatgtcggggctgcagagcactccgacgtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatgtaagtgccttcagcttgtttgggggagactgggtagagaggttagatgggagggcaccctgccctgaaaaggaaaacctgtaacctgaattccaggtacacttggagggcagactctcaggcatgtgggaaaacgccggaattgataagaaacatggaaattactttaaaaaatgaaaacataaaagccttgccaaaagttagggaacttttcctctaagttcagagtgagacagttaactcggtctggctcctcagcttagtaacccccaaagggagcggaaggtctttttccctaaggatgagatattaacgaccaatgtggtggaggaagtcaagggcctgcaccccacaggccccataaccgcactgatgtccaccttgtaaaacttgaggcctgcgttagaaagcccttcaactgagtaatgtaaaactcacctcctaagagcttttatcttctgggcattgtaaggcttgtccggaggaggaggatgacgatgctgatatgatgatggttataaggcgccctctggaggaaggaaaatgaaagtacaggggacagggccttaagcagatggaatcccaattaaagcttctacggatttatacagattaatgatcagcatttctggttggagcctttcccagtggctagtcagtgaaccctggaaagaagaatggatgctacttggagtgggtacattctgaaaagtaatataagtgtctcaattcactttctagtcatggaaatggtaacattttttaactcaaatctgctctaaattttgtttgagcctgagaattacccctttgacatgttcccagtgataagcaaacattatgaacgcagcaagttgagaaatatcaacattgagatgagactcaagagaccggggtttttcccatgagtctgacaccaatttgctgcgtgactttgggcaagtcaaacggccttttctaaaatgtgagacagagattaaagggaccccaaggccactttccagctctaggttccatggccagactttcatgtcaacagagaatgaagaagatcagtccgttttcatcttgaaaatggctgccaaagtgctagacaaagatattgactagatgggggatggtattgtctgaccacacccagtactccaaaaagttgttccacccacacagcacggtgtctaccactgcataatttctaatgcatttgtgtgcttgtgtgtgtgtgtgtgtgtgtgtgtgtgtgtgtgtctgtgtgtctgtgtgtctcttcccccttcattcacttttagtatacatactgtggatactaaggagtaattgcagtgaacaaattcacattaccgagttcatatttttaatgagatcttgagagtgggaggaaagagtcggctcctagagaataaaatgaaggcagacttagggaaatttgaaggtacaaaggcaacttaccttctgatcaacagccaaccacagtctggaataaatgttatcaaacacacattcttcaaaatggtccatgtctgagtaattaaaaggcaaatttccaaaatcataaggacttccgttaatcaagtcaggcataattattcttcctactgatggacacaatgaagtaaacatatcattcttgtaatttaacagtaattctcgtaaattgcccttaaatgtcagtgctggatgtggtccaccctcctaaattgtgactgttgcaacagatgttctcacttcaaataacgcacttcttggccacctaattaaagcaatttttggggtgattcatcctactgcaagcttggccacacttgtatcctgtattaacctataatttttgtaccgtaggagaagaattcactctttaaggacttataacaattatggcaaaaggggggatagtacttttgtttattttttctattatttttcaagatctttaatccggtttttccatttatacaaaactctttctccgagacaaaaatgatacatattggtaaaatgatcttacctaatttaagtgaactaatttaaagcaaaattcagatgtctgaattaatccattttcatagttaataatgtgcaaattagaccttttgaaaaaggatattaagaatggtacaaactcaatgaagtactaggtaacttcaatgttttataaaaaagtaagtcagcttcaatgtttcataaaaaacaaattcaatatagaattttaaggtaacatactttcctaaattttaccttttttcgatatttaggtattaaaaatgatcaaaatcataaattatttcctcatcaatctactagtcttacattcagcgattcatctgtgcactttaccagcttaattgctaagcattcaaaatatccttcagacacattaatatttcacaacagttataaaatagtaaataattaataatttaattcaaaatacatttacatattaatattgcaaacaaatcaccctgctgatccctgccatacttttgacctgcataatttctaggtcattaaaatattcttaaaaaaatataattggtccttaattaggtaattcaattctataaacttgtttctctatttgttaattattgctattgatccatgaagtgatactaataattgtttcctactttttcttttttttttctacagctttacaagaggtgagtaaaactttttttagaatttttaaaaatactttgattcccttggctacagtgatgtcttctcttggaagggaagaagttacattaatattgaccatcctagattcccaagaaaattgtgaagaattatgatagtcaaaacctttctggctgccttagaaagtacccacccaattttccaaaataggcggggctactgaataagactaggtttataaaatattcataagaaatatagagtaaataatccaatagaagtttgagttttaggatcagcttctatgaagcagaagatttcactgagctagagaatcttttcactcctttggaattatttgcaaaagcacttattgttaacacattcttagctcatgagttgaatttgaggcataagtacaggtacgtattgctatgtattttttgttctgtaggtacatatttttatttgacatgttggtaaaattttaaattgtagtttgaaatattaaactgagataatagtaaatgcataatgtaatgaattgtgaaggtatatttgtatactacaccaaaatggaagctgtttttaaatatatatatacaattttcttcataataatctttgatttattcttttctaggaaactgtaagaaaggtaagagtacactacttctccataaatatctaaaattatcagggataacataatttaactaaatttatagtagactatagaaggaaaatactttatcaaaattttgttcatatgaatatacattagctaaagcataaaataaagtagctttgatgtttaagataacaaagtttaattatcttctggaatcatctgtaattacatttatgtgatacaaactggtgatttacatacaaaaggaaaaaaaaagacttgtttttattctggagatggaaggcatattatgttaattatagggagtaaaaaaagtttattttaaagggctttgactatataaatgtgctgttaaaaatgtaacaaaatgatcatttaatctacagttatcatcttattcaaaatgctatgcatagtattgacctaatagctgaagactatagcagcttccaatcctccagctgaaaaaaaattacgtataattacaattaaaatatatacttttatctattgcattgtgtcaattttttatatgctatctaataacattgtagttacatcagtcttaccaactaattattatcaagaatgatttgtttgttcactggaaattacttcttaggcatttattattgtcctgtttgtatctttcctgtagggcccagccggagatagaggaccacgtggagaaagggtgtgtaatttttgaactataaagggcttcgtcccgtatttgaataactatatgttagaaactacaggaactggcaatttataagaatattatgtatccagataattgtacacccctttaaacaggtaatgcactgcagaagaagcgaatgagcattattatatatgatcaatatttgttttaggtcaaaattaccgttaaaaaagaaaaactgttacagtcatattctttgcatggtctactttctttatttgtaattgacccatccaacacatgcataatggaaatatatctacctaccaccacagtcctctttttaacacatttcatttgcttttgaactaagatcccttaggtagcttggaaataatagtgaattagtagtcagtaacatgtttctctgctcaaattcatgcatgtacaagtcaggcttacattttatttgtggcattcttaaatctccctgctatgcttatttgacatttataactatgtggttttgcattgtataacacttttgccaatatatgaatacctatatcttatatctattaggaagaggagacttacatgtatttcactcaatttattagaaatagaattaaatcagttaattattttaacaatacaagtagttaatgatagtaaatctgcaggattttctctcctatgataaagtgaccttattaactgtcacatcagttaattcattcacatgtaacataccaaaacaattgaatcagtttgtcacagtcagagatcggcaataaaaatacgatgtaagtccttgtgcactgttaaacatatgaagcacgtggaaccatacattttggctataatttttatatttgaatactggagcttcagtatgaattaatattcaatggccgagatagttctttaggaaaactaccctgtgatatcttaagagttattaaccctctttctaaaatagactcataagtgaatttcaatcaatgacaaatatagtatattaaatttccaccctacttgcacatagaaaggtctgaacaactgatcttaccacatataattcttaggtttctacagggcctgtctaacctgaccttactcactttttacataacagggtccaccaggccccccaggcagagatggtgaagatggtcccacaggccctcctggtccacctggtcctcctggcccccctggtctcggtggggtaaggtgtcttacgtattgctaacttttagctaacttcagttgaaagaaggtttattgtggaatttatttttagcagttaagggataattcttccatttgaaaattagtatattttatttcatttatttggttttttcactcaagattctgctttacccattctctttgtgagcccttgtcaattacaggactggtctttgtgtgcactgaagttagctgtggccatcattaccattatttaatttggagatttaatatcttttattagtaaggcacaaataagaggtgttgcattattaaggattttgattagattgaactgtgtaagtgaaatccctgatcttaagcaattttacaaacatcctacgctttttattctccttgacttgaagtctgctgaaccaacattcaaagcggttttaggtttaatttgcttgaaactaatttgagaaaagtacatttccctttttcattaatatcttcttttagcttcatgtctttaacaatggtatgagtgccaaatgacctcactgcaggaaggaaaacatatttgcttaattggttagcactatgaatcagaagcctgattctaatacccaactgtatgtcagtaaaataagacctttctcccccaaagatcttattatgattgcttatctatgaattgcattaaaaagcagcttctttaatagagctaccactataagagagatctttaacagtaaagttattactgtgaactagtttttagaagttttatcttccaaggggtattttaatttaattttcctctaaacttgaaaactctttatgcccttcctgaaactccagcaagaaaaagatctcttagtcattttgtgtagctccggtggggaagggcaacaggtgaaaatgtgaagatgtcctcttgagctctgtctaatttgtcaggagcccttagtaacattaaaagtttagaaagcttcccttcctcagagtagaggtaaaaggtgggagtggagacaccgagttaaggcagaggaagggctcaaaaagtaaagtagggaagttctccatttcaaagaggtgtcggccaagtttttgacgtacagctctcataactttttaggaatttagttcaatatagaattttaaactaataattatatcaaaaacattgccctcttttaaataacaacagaaaaatatttacaagtagaatgagaaaatgaactacatgactagtaactaaaaatattttatatatatatataattttttttttttacttctctagaactttgctgctcagtatgatggaaaaggagttggacttggccctggaccaatggtatgcttatctgtttatcttagccaaaaaaattgctaaataaatcattcattttatgtcacattttaccacgccatttatttagctacctaagttaacactcaatacttagattatataaaaacaactctttttgttttcaaatttatgaaaacataagttaaggagttcacttttctttacaaaagaaagattaattgatcttttatgattatatgatctttttgattatatgatcctcattaagatagatcatatacttatgtccaagaaataatctttggacatagtaaccataacttgggcaaatcaatttaatttaaaacagtaatcactctgattaattttttaatattctttaacattgcttagaattttaagcaacacttagaggcatagaactatttattaagttctctgaacttgttggaaaggatcaacaagttctatctagtccagctaactcattttaaaatgggagagtttaagcccttttctcaaagtcatccaggtaactaatgacataactagaactagatgccaggcaagatgtctaatatttgcttacatcatggtttatgtacctagtccttgaataaaccactcatttagtcaacagatattaatcagatgccttcaatgggccctaaactgtattaggaactggggaaattacaaggaatatgacagattctgatccttcctcaaggagttaacaatataggaaatgtttctttttctgaattttgaccaaaaaaatccttttttagtctattgattgtaaatctatatagaagagagtatgagtaaaaatctagcatttatgtcactcagtacaaatattcagcaccataccctatcagtggagcaccgcttagaaacattccctatatgatgatgatgatgatgatgactattaacaaatgaagcttctaacaagcattagagagaagtttgaagggaaaaatgctaatacgagcatgcaaaatgtatactagcatatatgaaatagaggggaaaactgccagaagtcaaagtgttaggttgattaagcactacagaatttaatgtatacacacacacgcaatttagtgattttaattaattgtttcaaaacaaaggtatttatctgcccaaagtcaacaaggtctttaaaatgtaaattttacctgagcagtgcacttagtgctctatcttcaaaagaagatgttctgctggagctaatggcccacagtaagctaatatactctaagggtgagataatattttctgtaaattaaaactcccacttgagaaataatgtacctttaattgacgacttctaattccctaattttttctggtagtttaaaatgttcatatctgaaatgaaaaagtagagtgtttcttttggctttgtttatattggatttttgaaattagctgtttcagctaatgctggacattagtcagttttaaagcagtacctacatctcaagaagaagcaagggggcggaaagtaaagagctactaaatgtcatttttaaaaagcccactaagctgggaaaattaatatggatttcagatacccctgttttcggaacatctgtcttggcataaagcagagtattttactttgaaatatcagtgaaatataatttaagcttgcacatccacacacatgcacagacatatgtaatcaacagatatctgtttcacaaatagggaagataggcagcaataaagtattaaaataatttccatgttggaaaatcaataactataaaaccccacagggttcttctctgaattaatgagtaatcacagcctccatgaaatacactacattttatgtaaatgaaattgttgcaaatacatgaaaaaataaatataattagaaattcatgatgtcaaagaaaattattttttaatgtatgcctaaaaagctattgtgatggaaaagtgacagtttcttttaatgtcagagcaatttctaaaaccaaatgaataattcttataattaaaatgacgtacattttagataaaatccatgttatttcactctaggcattaatacagtaaggtaggtttgactgcagagtccccacagctgatgtcacgaacaaattacttgagactggtacatgaaatattttcagcattatgaggaacagaccctacggatgagcttacacaggcattgattactgcaaagaggagtcaagaaagtgtatttagcttacaaactattaacagcctgttttaccctacttttgtgctatggaaacaacaaaggggaaaacaatcttccatcatttgggccatattttcaacaataatatcatataatagactcttccagaaggctgtttcaataatgttttatttttccttcacccctcattacatccacttttgtttgacattttcatcagtcaccaataacccttagaggagcgataaggttataacaaacttctctctaatcattaagaaggacttttgattcttttcaatttatgtcctttgtggcaataaaaataccaatttcttagctaaatatgacataggaagatgacatatgatcaaagatatccaaatggacatgcttcatctgctgtatagaagacaattgtatattctgcacttctgcaaagactgattcacttcattgcatcagaacaatctcaatatgcccaattgtgcacaactttaaggaacctatctgccccgtctaattctcattgatttctgttgatatggattgggagaaaaggaaaagcaaagggagagaactagtgcaggaagtttgagtccttaaattcttccttgggaggaataaaaactatggaatcaaaccacaacaatggcactgctaagttggtcatgtctgaccccagccaacaccatgacaacttatcagtgctaactgttgatatatctgctttctttacagggcttaatgggacctagaggcccacctggtgcagctggagccccagtaagtactgaaagcttgtaatgcctcttatgtaaaaagacagagaattaagaaataaaggcttggagtatgacattctttttttcttttagggccctcaaggtttccaaggacctgctggtgagcctggtgaacctggtcaaactgtgagtacatttttccacctttgtgataagtttttttccaggaagtttatgaatataaccttagtgaaatgatgggtctcccattttcttagggtcctgcaggtgctcgtggtccagctggccctcctggcaaggctggtgaagatgtaagtatttactcttaagcactttcaaaatgctatttaaatactcttgcctcaacaagattttctagattcaaattaagtattctgccaaaagctgaatatgcctgacagaactcttaatgtatgggaaatattattttaatgaaatattaactaacctacttgtattaagggaaagattaaatatatatctggatccatatttttatgtgataactttctccccttttgtaaaaaccaagattcccccattttgtctgatagtttaccaagaagaagttgactctacaatgttttcatgtttagggtcaccctggaaaacccggacgacctggtgagagaggagttgttggaccacaggtgagactttttacattggtagatagcacaaacatcataggcctataagatagttgctaaaactagcatcaatctaaatgacaacatagatgtcacccaaactcataacatgaatcgaaggcatctaataaagaaaaaagcctagttaaaaaaaaatgcatatacattttattcatgcaaataatggaatataaatgacagcaagcataccataagcaactaaattgtgttttctacaaataccgtattattagttactcacattagagcaagttaatttgtcgctctgtgcttagaggtatactagactttggttcaaagcttgaactttgatgagaataaatactttggagggaagaagtcactgtctttttatttatggtaaaacattattcaccatcttctgtatttctttctaagggtgctcgtggtttccctggaactcctggacttcctggcttcaaaggcattagggtgagcacattctttactcagaagagagaaaatgcctattaatttttggaaaaaactcaagtatgtttaaaatcttgggtgacatatactcactttcaaatccctggagtttgccaaagggaagaaagagttaaagagtcagatttcttgaaagtaaagtggggtgcaattttttcagtctgttcatagctaccaaaaaacaggctcactacagagaaaattatatagaacatgtattacttattgagtatttacaaccgtctgaaaatcataaaattattaaggatggaaaagatgtgagagaacacctagtcctccatccttctctctcaatggcaagaaagttaagtgacctatctagggcaatagactgagtttgctgggacctggaacactggacttctttctactgcagcagacaagacttacccaagagagattaatggcaaagatatacaatacaatttttatttgaccaaacactatcatggaacagcattttataataaggctttcctttcagggacacaatggtctggatggattgaagggacagcccggtgctcctggtgtgaaggtaaatattaaattagaagcactgtttttaagcacttgattgaaattccccatgacctccaaaaaagtatattatactgaagactacccatattacaaaaagtatttttattttttttctttcctgtacttcaaatccctcaaggatggggactatgagagtctgtgaaaaaaggtcaattattaatatttattaaaattcaatatctattaaacaattgagataaaaataatattaatagtttcttgttccatttcctttcctccctctataattccagtgtatctctgcagccaaaataaaagtaaataaacatataatcagagattacgacactctgtattattttaaactgtaaattctcctttgccacacactaattagataggtacattcatgtcgctatacacttttcaacctctttcctgtgatttatctgtgcacactcaaaaaaattttaattaggtaattaaagtctcagaagtgtgttatctcttggctaggctcttctctgacagcgttttcaactataaaatgttctctttcctattaaggagataatgtgatattaaagtgaataccaacgtaattacaaattaatgagtaacgaatactagcgggaccagaaatgaacatgaatatggagaatctattctaactttccagctgccacacaaatggataaggtcaaactcattctcccaagagcccgatataacagctcagactactaatcactgtatcataaaatgttagagctgcaaggagctttggagaccccctcattttgcagaggtgggaaactgaggcttcgtgagagcaattgacttgcccaaagtcacacatctagaggttagaaagtcataggctagaaatgatccccccttgccacttcaatgcttattcccaaagaatagacttcacatagaatcctggaaattaagggtccttatgaggtctcttaaaccatatttcccctatatctaaatcagattatctttaaaaaaagttcttttacatgtgccatagtattaaatcccactactactactactactactactaccctggtttttactcaggataagaatatagattggaaataaatatgatggctctaaaaaataccatgaagcttcaatttttcatgcacattttatgaaagtgataacactgagtgttcaaaataactttaaaaaggataaatatggttacattgaaagcaaatttatcctttgccatctctttttatgatattgtttctagtatataattgatatcctgaatctaagggagaaattggggaggaggtacactcaaataaccacatctccttagaacctggatatgtggtactatctgaataaaaactcatgttagcacattttaaaatctgtgtgtctggcataattgaaaaacaatctatatgtgtaagaaatattatgaagtatatgaatggttcaaagtaaaaaaaatagagtaaaattgcactatcaggaaaaataattgttatatttaatgaacaaaaactcaatccttctccatgtagggtgaacctggtgcccctggtgaaaatggaactccaggtcaaacagtaagtattgactacttcattgtaaatttaaatgtgtacactctttatgagatggaacttctttaatgtttttgctaatcactgtatccttcagcattgtattctttgatgtttttctaatagccttctgatacttaattgaaatccactactgtttagttggaattagaaggcaacttatttatttttagtgtattcttgtacaggttggaaactgaacaaagcaaatgatgcctgtgactttttttaaattagcattctggattttattgaaaatatttctgcttctagggagcccgtgggcttcctggtgagagaggacgtgttggtgcccctggcccagctgtaagtgcttccatttttgttcagtttcatccttttaaaaaatcttctaatggctgtcatttaagtttccacctgatcttccctttattttcttcttagggtgcccgtggcagtgatggaagtgtgggtcccgtgggtcctgctgtaagttttgacactggggagtttgaaaggagttgagaatgtggggtgggtgctgtcttcttcattaatctcttacgaaatagcatcatttcagacactttaccaaatgttctgtgaggtcttttgaaggctccatttataagtagtgtaagccatttataagtacctgaacttttgattgatgtataaagcaaaatatccccaccctggataccatgaatgtcttgcctttgatgagatcctaacgacaacagactggttgtcagtttttttctttactaatataaacagtgtcatgccactgtaagcaacttcaatcttctgccattgttattgttttcttaatttacttggaggaaatttcttaccaccttctgctttgatttcagggtcccattgggtctgctggccctccaggcttcccaggtgcccctggccccaaggtaaaaacactggtgaccattgtcactactttgataaactttttactgtgatgtgaaagattggaactgtgtttgcagataaagagataattacgaaacagttaccttaattattccttcccttcaaaatggacatagaatgaccagttttctcactctacatttgaaatagatcatttctctgcactgtgcactgtgcccatcgatatagatgacaacatggaaattgtctctaggactagttagttaggactgactgagaaccagagtcaaccacagagagacagaaggagagggaaggtagtaacagtagccaagatggcagaatcaagcaaggaaaataggaaaccaaactcaaatcttgtaataaaacggataagaaaaataattgcaattttgaagttttatgaagacatttcataaaacttggcatcttaaaaacagatatgctgtttcattatttgctggttaattccttggtttaatttcctcttttagggtgaaattggagctgttggtaacgctggtcctgctggtcccgccggtccccgtggtgaagtgggtcttccaggcctctccggccccgttggacctcctgtaagtagccactgtctttaaactttattgagtaaaagaaaacaaaggtggagtatggggaagaagaagaatgaagatggggtcaaagaagaaccgaaatattccaattaactgatatccttctcctttccttttcctcatagggtaatcctggagcaaacggccttactggtgccaagggtgctgctgtgagtatacctgtgtagctaaaatgtgctgctatgattttaaaggcatttaatgtgtgctgcctctacagcccatcacctccctaatggaccacactgcattttccttcatagggccttcccggcgttgctggggctcccggcctccctggaccccgcggtattcctggccctgttggtgctgccggtgctactggtgccagaggacttgttgtaagtggtcatgactgtggttctcatcatcctgaaataccacctctgccatcatttcatcactatctagacttccacttgtagttttattattcctatttttctcttccttagcatttttagtttatatttcttatatatatatgtacactcccgtctgctatatgcacacagacatgcccttcctgttatcttaaatcattacctcaaggtaaatgaggcaaagttctacaatatcagttttgtcccttcgaccaataataccattcccctgtactcaatttaaatatgaacagggtacatttcctagagaacttgagcttctctttaccttgacccacaaatattctaagagatttgtctgcaagagagtttcaacaaatgtttgtcctttgaccactgttctgtattgaaccctagggtgagcctggtccagctggctccaaaggagagagcggtaacaagggtgagcccgtaagtagctctatcatcacacttttataaagttaattgtttttctcattccagtttctccagctggacatagtattaaaattatttttttactccctcttcttttgttcttttcattaaacagggctctgctgggccccaaggtcctcctggtcccagtggtgaagaaggaaagagaggccctaatggggaagctggatctgccggccctccaggacctcctgggctgagagtaggtttcaaatgctcccaacaccctaacacaccagaggcagattatgataccccttcattgggaattggtcaaaattactgactgtgttttcttaggcaaaaaaagcatctgctttccatctgccttattaaatcagtgactctcaatttaatatgttataaaattggcctggaaacaatgttgacctacttttgcaggatgctcatctatgaattcctctaggggttgggtgaagtgttttggcttggtttgtgtctgtatctcccctgtaaggagatcatgctatttttaacaaactctaccttatcaaagccaagagatttctttaattctctctatttcatgtactttcttgcagggtagtcctggttctcgtggtcttcctggagctgatggcagagctggcgtcatggtaagctgtctatcacttacttcctagaaaggggcttgctgcttctggtggtgggtgtgtcattagctttagcatcctcctcctctatctgttttttttttttttttgaatagggccctcctggtagtcgtggtgcaagtggccctgctggagtccgaggacctaatggagatgctggtcgccctggggagcctggtctcatgggacccagagtaagtttcaaactgattctgagcaaatcacacctggcattacttccttctttaaagggttggttaatattgaagataacaataaaaacatcaaaagtaaatttgttagtagtcttgctgacagttgcatttttgactttatcaaagctcagtagatattttcatgcatttaattagttcataaattttctatttattacttgatacaatggctatgaggtttttggaagaatagatctattttaatatatccaaattagattggtcctcctatcagcatgaatcttttatcttaatttgtgagttttatataaggtgttcatgaaatatattaggactatacatttttggtttattagattcataagtgaagtctttttcctagcaatcacaaagtgctgtaatgtattcagcatcacactagctatggagaaataacctctaggtccatagacacactaatccatagcaatagagtaatttttttgcctccattacctcttatgggtgaatatcaactgtaattgtaccataaacaagtaatagggacaccaaatatagcaataagaaatccactttggaaattgtttactaaaagtattagtttttctattatgaggtaaataacgtgatacattttgcccatatacatgttgcttaacagtttcttgagatatctataaaaggatgagttgcactaaatttcaataaaaggaaagccacaaaaaaatagaagaaaaatttcagaactcttttcacacttcccagctagtggctaatattcctaatgatttaccctaggcaacaaacaaaaagtcgggggaaaaggtgcctttgttagacttcagttaatctaaggcttgagtatgtaagttaaagtgccaatataaaaacatcctcatttattttatagggtcttcctggttcccctggaaatatcggccccgctggaaaagaaggtcctgtcgtaagtattgctcattttccattatattttcaaggacacttattgcacccttatcaagtctattttgtggcttatttatacatgaacacattgaaaataaatatcagacacatacatcatctgggaatgcagagtaatagattgtaattatggagtccaaatgaatacaggactgaaagcagagcaggggagagaaaaacatggcagggaaaattgaagcaggtgacaaggggatgcaagagaagggaatgagggaaattgcatacatacgagattgaattggctatgtgtgtactgacatcctagttagaaaaggaaaatggattcataatttattaacgctttatacaagaagctctatgcattcagaaaactattctgtttcatccgtggcagcatcataagcttgaggttgtgagaatatgttgacactgagtaaacttgaaataactctgctttcagggcctccctggcatcgacggcaggcctggcccaattggcccagctggagcaagaggagagcctggcaacattggattccctggacccaaaggccccactgtaagaatcaccacaactttcttaccctcagcactttctgtagccaaattttaccaaactctagtatttatctcctgcgaatcagtccagtctcagggagtttcctttcaacacaggaaaactgcaggccacttatcacattaaaagtttacctctagtgtatccttatatccctgctaaaaatccatctcctgagccccatgcttccacagacacagggacatcttactgtacatggagctgcatggtgatggatcatccttagataacagaaaccacagactagggatctcaaaagaacacaaaaacaagcaggattcaacattgcaaaatcaccgtggttaatttgacattaaatgtgcaaagctgttctttgttttgtttttcatttttactctagggtgatcctggcaaaaacggtgataaaggtcatgctggtcttgctggtgctcgggtaggtgctaacttgtgtacagatctattcacatagcattcatctaagaaccacacttttttttttacaccatctgatatcattttgtcactttcttttcaagatggcatccccaggggtccttttactatcataaaatgcctttttaaaaaccaaacttataaaacagtgagcaaaaacaaatcagaatatacattaggtcaaaaatacagaagcacttggcttttattttattcattttgtaattaaaagggtatgaatatgtagtagcattctctggcctttataaattgccttgtgtcgcatacttcgcttgagtcatatcaaaagttagtaggcaaacccataaatatatatacctactatgtacccacacaaattaaaaatttaaaaagttagtaggcagtatttgggctttcgtgggaacccacaatgagtttaattcatgctaaaatgacaaacttgttttaaggaagtaatacctgaggctttgagacatcttaaactacctggcttgcagctaaccatcagcctttctgttaaatatttttagggtgctccaggtcctgatggaaacaatggtgctcagggacctcctggaccacaggtgagtatttctcccactcttgtgctcttctgcactagaatgtatatagtcctcaaactggccatctccattttcagtccaaaagttatacagctagacaacagtggtgacatacgttgctatttatgctctctttcctgtcactttcagggtgttcaaggtggaaaaggtgaacagggtcccgctggtcctccaggcttccaggtaagtcaactcaaacatatacaatactgcctttggtcagcctattgagctgtaaatcaccataccgtacctctcttctccaccacaataaacatgatttcaggactgaagcaaagaaaggtgcatttttttcaaacaaacttttgtgtaatgcttaataacatacaatcgtgctcatgttgatatttggtagccaccacccccaaactcaattattagcaaatctcctgaacgtagccatgggattgagatttgtatttcttttcatttttagggtctgcctggcccctcaggtcccgctggtgaagttggcaaaccaggagaaagggtgagtaaaacaagtaatagtaagtagtaactactaaacttgagaatttccccctgtttaataccccactgctatgcaattataatatgtaaaagaaaatttcgtatttcatatgttaatgatagtgttttacatactttggtgctgatggagagaatgagccaaattactttagttctgattactttgttttacagatttaatgaaacatcaccttatgaaagtaaaatctatcaatgaatattttatttaatagccttactttttgtattgttcttgataacgttaagatacaaattatttccttccccatagtgaaaaagtaaatgcacaattttcaatcaaactagatcccgaaaaattccttttgtgtttttcttggcattcagacatgacactactatacacaatcagggcatgagttctgagtcattttctctctaattgtgatgaatgtgcccctatttagttacattctgtggcctggtctcctttgtcaacagtaggacatattaaggagacagctggtcagtaataaaagagatacacttgggtatacaattaactaggcaatgtacagaatatgataatttctcttaagaagacgatctgttatacagctaaaaataggcaacgtctaatattcattattatttatcttattattgaaggaaatagtctgtcactttttaaaaagcaataaactaaataatgggaaacaaattttttgataccaagttctgggatggatacatttttgtcaccaataaaattctctctttctgtatctttccatactaaaagttgttcttattagcctgtgtacttatgcactcatgtagatactgccaggtttatttcactctttccaaatttttcaaatattttaatcataagtgaatttagagatcacacacagatttcatgctttattctcatgttttgtctagggtctccatggtgagtttggtctccctggtcctgctggtccaagagtaagtgttacttcattaactttcataaactctggcaatgtgtttttaaaagtagtagtgctttctccttaaagccactgatgaccctgcaacaagtctctgatgctcttctatagtcaaatgtaatctgtagaaagcattagatttctaagttgatagtagaattttttgtttcattgctcatatttcctattcaataattacatagttataagaaacacataaatcaatatatattatagtcagtgatttatatagacaactatgctacatttgtgacagtggctcaacttgagctaaggaaaaataatatgttactaagatataaagttaattttggccatgtgtgttgatgttcaaagcctaaagccgaacttatgagtagtcatataaagaaaaaaaaacttagtttctctatgggtattagcatcactgaaatgattaatttgccctgaaagtattccatcatgtcactagttaacacatatgtaggaagctcaaagaaccaacttataacaaggtcctttgaaacagttacaacgtggacctatgtgataaatattttgggctatagaatgctatgctctagtgatatttagatgtaaattgggagatatttagatagacagacatatatatatatacacaaatacatatatcaaatatacatatgaatattgtaactgttatatcattattacacagggttataaaaagggggcatagataggagaatatctaatgttatctacacctgccattgctattcaactaaaatgacacaatcttttctttgaatactacacataactggcatctgtttttacctatggatttatcacagaaaagactcctcaaagaaggggaatgaattgcaaaaattgaatattatactctagaagcaacgaattctggagtcgtagtcatggaacattagagctaagtgacactttagagaatatctcatcaatctcttcattttactagtggagaaattaggaacaaaagaaattttaatttgctaataaatgcaaaccagggctcggaagctacacaaatgtaaactctcatatgtaaaacagtatcactgaaagtgatgaatggtgcaacacttcttctaatcacttttttcagggggaacgcggtcccccaggtgagagtggtgctgccggtcctactggtcctattggaagccgaggtccttctggacccccagggcctgatggaaacaaggtaaaatcttatgttttctatattgctggtttggcccagtctgcctggaataagtagaccctttacaatagaaagataattgtttttcagatttttatttatttccagttctgtgatgacttccctctcagtaaacagcaatccgattccagtggacctgaattattctaaacaaacaaacaatagcaacaaactgtgggggaaaattcagagttcccaaaacataaatgaattagtatgggttgtcactcttttctcctcacgctgtttatgcttttgttttaatctagaaacattgtattcattggacattattttcagagaaaataactttttatcttaacatctcatcccatagagtaaaatttcaacaagtagtctgacttttaataataagagtttatgatgatgaaaattcattgggcaatacattcacccccaaaaatttgtctggaaacttgtgttccaaaatagaatctgtggtttagattttaaaatagatttaatatacattcctgaaaaagagattaccttaaccacaataaaaagaagacaacacatattattttcattcttaactctaggggaaaaaatgtaaacattagttgcaaaaagctattttagtgtatggaaggatgttcttgggaaaaaaataaaaacataaaagggagagaggaaataaagaaaccacggttttgtgaggtagtactttcaaagggatctatttatctcagaagctagtcaacaggttttaagtatgtggaattgtagggttttatataaaaatggaagatacagtctctactcttaaggagattaaaacacaaacatctcctcaattgacaaggtctctttccatgctttctatctgggctaagagacttatccttgaaaaatgtttgtgggtaaacattttttactctctgcttcccattgtcctatcctcttctccatgcctgccatccttaagaggactgaagcaggttatagaggaatcgcagctgtgcactcccactaccctcatctcttcagtcaccatgtcattaacagcatctctctctgctatattctccctcctttcaatagcccagccttctttgtgtttcaaagcaggcaagaagcctgtctagctagctgtttaaattggaattcttctagagtttgattcttcattttcttctttctccactaaaattgatttcacatgtgtttgactcaagggtgaacctggtgtggttggtgctgtgggcactgctggtccatctggtcctagtggactcccaggagagaggggtgctgctggcatacctggaggcaagggagaaaaggtacgtgttgacccctattacatattgttgatgaactctagtaaagaaggctgcacaaggatgcccaagttttcacaattcttggcaggtggtctggtagcattttcatatctatctatatacatttccctctgccacctagcacctacacatttctaaactcactaatctggcaaaattccttgctaccatggaatttcacacaaacagatggtgttgagtaatacatgaggctcattttaatgccactaacaataatgcctcatcctgtcctaattaatgggaagaagctacattgaacagctgtcaaccatgctgctgcattagttatgccgtaagagtgatcaggcgctgcagcccattgtgatgttgccttacaattctgtccacatgaatctgtaccttgcttgattatgcttcaggagagtgtacggaaattagaaaagattgtttaacaataatctggaaatggccttgaattattttttcctcattatttttctcgattaacattctacagaatggtaaggaatcgagacattgctaaaaatcttaaatgactgaaggtatcatagcatcttctgtaaaaaagaaaaaaacttcatattaatttcgattcaaaattttggtcagaaaacaaaaagttgctcttgctttatactttcagggtgaacctggtctcagaggtgaaattggtaaccctggcagagatggtgctcgtgtgagtagaattttgtttgtatgtttcttcgtacttggattttttttttatgtttgaattgagaagttttccaaattagaactacacacactttatttatcaagtttaataaaataatattcctttctctcctgggtctatgactaataatatcattttacatgttccaaaggaaaaattaaatgggatttaacctctttgaaaataatatcctgaattttctaacttccctagtgtcaatgataccaactacaaactatagaccaaaagctttaggtttaatagaatattaaatgattgcttcaagtgataacagagattaaaataaataaataaataagtctcctatgctttaggaagccgggacctctaacaagattctatagttattcaaacctactccctagaaatttatcacccaaagagcagccccaaagattagctgttaatgccatgaagatgccaaagataatcccatgacagtctaattaccttatctcgtatgtcagcctcatgggtcttctaggccacagtcggcctggattcctttattcacctctccttcagagctgaaaactgactgtagcacatctgtaatagtctttcttttgaatcacatagttctaacagtttcaaacaaggctactcatttgctgctctccagggaattttacaatagcggaaagttcagatctcccaaatttctgacctgctattgacttacacatttccataacctttattactggagtaccctccttctgagagtggcttctaatagtcttgttaattagaaccaaaatacatcagaggccttctagatatccaaccagagtgcagtgaaagtgttcagtcactgtataagcacagaaaaaaagaatgacaaggttcacttttgatgatacggggtgttattaataagacatgtttcctttttggtactagggtgctcctggtgctgtaggtgcccctggtcctgctggagccacaggtgaccgggtaagcatgcattttcactaagccaacagcaatatctaaaatttcccgccttccctagtcccaaagagccccagcaattcatttttatggcttggtataaagcctacttatttaaaaacctagctattgtgatagagcagcaggaaacaaatgctgtgtgtttaaaattacttttcccttcctatagatttgccagctatctgatctatactctaatccctagcatttgttttaaagtctctccatgttgcgcattaacaatatcctaatgcactgaggcttctcaaagccttcaattattaccaaaaaatcaataaaatacatagtgtgcccatttcacattgaactctccacttaaaatagatcttatttattgtattgcaaagattgccacaaatagatcagccccgtgtccatctaaaaattaaaatgtcctcctcctggtattgtaggcactgatttatagtgttttctcaagtgtataacccataccacttaacccccaaaatgaatatagcattaagtaaaaatccacttcattttactctgtgagatgtgcgtcagttatctcttccaaggcaactacagactctgtctgtccaccactgttctctctccctcccagttctttgagcatctatgtcaggcacattaacagattcatctttggtcccattatagggcgaagctggggctgctggtcctgctggtcctgctggtcctcggggaagccctgtaagtaagaacctgggtcattttgtatactcacacctcacaatgtttagacattgatgaacctaggattgataacacatttttaaatcccttctcccacctagggtgaacgtggtgaggtcggtcctgctggccccaatggatttgctggtcctgctgtgagtatcacataatgaagattaatctgaaaacatcctaagttggggagtagagtgggtcggaataccagagctgtaactgtttatttccaacagggtgctgctggtcaacctggtgctaaaggagaaagaggagccaaagggcctaagggtgaaaacggtgttgttggtcccacaggccccgttggagctgctggcccagctgtaagttgaattcactggtggtccacacagcagctacccattagatcttccaattaaatatatatccgtcaagtgcctgctatgcaacagggaatataccagatagaagatggaaaataacggaaggattaacatttgcacactgctttacaaagtataaaagtttcatgaatattgttttattttaattctctgataacctcataagggtggtaatattgaagaacattctgacacagatagtcattttttatttctatattttcttctaagagatgcgggaatgatccacttgaagaaaagagtagcatttacaagggtttgtttgtgatttgactccatctttttgtttgcatttagggtccaaatggtccccccggtcctgctggaagtcgtggtgatggaggcccccctgtgagtatttacaatggactctcgccgcttttcttttttcagaatctattaaggacacttgaaagttttgaaatttttggtaaatttggactaccatgaggaaacttttgagattcaagttcattctattcagagcaattccgatattgatgttaacttgaactcagctggaactcagtgtatgttgctatcagctcacttgaggtaataaccaaggtgggccctaggcagtttaattgtaaagtcggaaaaaatattccttttggcgtttattaatatgccccttcttctgcctgaccatgtccttctcctttgcaggcaatgctatcacaacaattctctagagacccagagctccccaaaaatgaactttactgacttcttctctcactggacagtgctgaattatctaggtcatttgttattcttttgtccatgaacaccattacctattaagtgtccatttccttaccactcagccaggtggtaaagatagttattaatgtatacacattaatgtgtaataatgacatagtgtcttatcttcatacctttacaaccataagataatatgtcagcatttcagaaaggaccatccaaaccttaacgcaaaatatgggcattgcaactggtaatatgctggtaaggaagatgtgtggagaaggagggccttcagggtcctggctaaataatgccctatatgaagctgcctgattttccaaaacaaagaaattcccatcttacccaaattcttggagttgatgttgactgtggaattctaatgtgcttggctcttagggtatgactggtttccctggtgctgctggacggactggtcccccaggaccctctgtaagtaaatcactgtaaacgtgtcttcatttactctagccaaaaggcctggcttctgataggaaactggtaagaaactcttcatgaaaacacatcactaatattcgctattactctcctggtctgaagtcagcttttctgaaccattaaggtatttcatcacaagttatattttataatatcagtttaagaggcttttattcatgtgaacaccagtcccctttcaggggcatggtctttttgaaaaaaaaaaacaaaaaaacgaacagttttagccacatatcagatatttctatatctaattatcctttatggctaacattctgcctccattgttaaggtataattgttcctgaatttaaaggtggtttggcctctaatttaattctgattcagactctcctgtcaggactcaagaaaatttaattaattaccaaggattaagtcttctggttaaggtttctgggaaaaaaaaatagcaaagatgttgatttcttggaatccttttacaggttcataacagaaaaatcttcattccctgtaggcatttaattaaacctagttgagaagtgtgtgggattcctcaattatgaacaaaacacgtatattggctttctttaaaaaaaaaaaaaagaagaaaaaagaaaaggcaaagtccttcgaaactcagagtcccattcatttatcattaactcctatcattctacatagttctgattccaatatgccagggtaccagtggcatgacattgtttttcctcatagaaatttgccatagtctctcctccattatttggttggttacagcctcataaaggaagacaggagttgcttctttctgcaagaaagaaggttaaaaactataaatatttcccccaaatggccagggtattattttattgcatcacattgtttgcatcttaagatctagaatctttgctgctctcttccaggcccttggtgattaacagaaaggaaatgaccttgtacatttgctcatagggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctgtaagtgatttccaactcctctttcttaataccttatgctgaattaaaataaagcccctacacaaatcttcaagtggcatctatttgttgatgagtattgcaggctctcaagtagagctcagttgagccaggaaatctgtccagcacacactgaggggctgtggcttccaagatgctcagaaagcacaaaatcgggaagacaataaatgagggaactcagttttatcacaaagcccttaaagctattgaaggcaccttactggtaccaggattagaacagagtcccattgctgtggccatcctactacatattaatcaatctcagtaggctaccaatttcttaaacatacactgtccagtattagtgctactctgaaaggtgcccctattagaccttagaggccaaagtcaaaatttgcttccttttgatatactgattttactgatttcctttttgtttttgttttttgtttttgtttttgtttttttgttttgggatggagttcccctctgttgcccaggctggagtgcagtggcacgatctcagctcactgcgacttccgcctccccagttcaagtaattatcttgtctcagcctcccgagtagctgggactacaggcacacaccatcatgcctagctaatttttgtatttttagtaaagacggggtttcaccatattggtcaggctggtctcgatctcctgacctcaggtgatccacccaccttgacctcctaaagtgctgggattacacatgtgagccaccccacccagcctgatttcctttcctttgtgtatatacccagcagtgtgattgctggatcttatggtagttctatttttagttttttgaggaacccctcctactatgtacaactattatgtatccataacaatttaaatttttttatttgtttccctgcctagaggctataaaaactctatttcaccaccccaagtgtctttataaatctcaaccacatatttttaaatgttgtgccattggtctcaaggatgaatcagatacaaaagtattcatgccaagatgtaaactcaccgtcatcactagagaaaagatatccaaggatatgtcctagtaataggaggtcattagcctttttctaagctgaagacagtttattctcacaatcttcaagccaacctgtgttatcacctagggtcttacccataatactcagtattttttctctatttagggacctcctggcactccaggtcctcagggtcttcttggtgctcctggtattctgggtctccctggctcgagaggtgaacgtggtctaccaggtgttgctggtgctgtggtgagtgcttgacagtattctgactccattaacataagaaaagattttaaaagctgccacttcaaatgtgacagattgatcactgaataacttcacttaagatttttattcatggcattttctttatacagatcacatgtcacttatctaagaagctttaataccaccttacttagacacacactataaagacacagcttaaaattatgcagaatgatttttgttctttccacgcacttaggaacgatacaatctctaattgcgtttactcctctgcaatatgaaatgctggcatcatttatcctgtaggaagaatgaaactctggaagttctgaatcgttccattaaaccttatacgtgacaacaactagaaaccatctcatctccataaaatatatcaactttttgaattcatttcatttgggatactgaatgacacgaggctcactttttacagagcaacatcccgtgattacataaagctggccatctacatgtggagaaggagggcagagatgatactaatgatacttcttaccattgtgtgacccattcacattcaatttaccttcttccttcaaactagaatctcctgagtagggttgttttggaggggaaggttagcattccatcgaataaggggaatgtcattttatcttctctgcctgtttagggtgaacctggtcctcttggcattgccggccctcctggggcccgtggtcctcctggtgctgtgggtagtcctggagtcaacggtgctcctggtgaagctggtcgtgatgtgagtccaacacttggtttgtaaaataaaactgagcaggatttcattgtgtgaaactttatgtcctgagctgaggttctcttcttccaaatttctgaacaagatggtcagcttctccatagtatctacacctagtactgaaaatatgaaaattgcttaggccaaagaatgggcttttcaatagcacactgcaaaactgggcccaagtatttaaaacatctctaaaaaatatctaggttggcaggtttttatccctagttttaacagtctgaaagagggttcgttactgagcactggaagtgatgaagacagagtagctacaacataggggctggtaggcagcagagcctcaccaacagccttaatttgtgtggtgtcttcacagggcaaccctgggaacgatggtcccccaggtcgcgatggtcaacccggacacaaggtcagtacacttttcatctttctctaattcaaaagtgattaaaatgcaacccagattgatgctaagcttcattttgcctttggtagggagagcgcggttaccctggcaatattggtcccgttggtgctgcaggtgcacctggtcctcatggccccgtgggtcctgctggcaaacatggaaaccgtggtgaaactgtaagtttgtgaataccagtccctcagtgcagcattctcgtgggcttcacttctgacttccccacacttggggatggtggaggagtggggaggggtatcttgggcctagctaagttgtgtttttctttttcatttcacagggtccttctggtcctgttggtcctgctggtgctgttggcccaagaggtcctagtgtatgtacatgctgaagatttctttgcaacactaacatttagagagaatcagtccaaaacatctgttaagaaaataaacaatatatcagctagacttaatattttttaaaaatttcagtccatgctgagaattgatacaaataacttgagctattttaaatctcttatgcttgtttgtattaaacaattacaaggatctagccactttacagatagcacaactaaagcagattaccagcagaggtgagagcctagctaaaccattacatgtcctgagttacctttgtaaacgaattaagcagtatttgtggtgaagtgagtgccatttttttaaaacggtaagtcttatccatccttctgtttctttatagggcccacaaggcattcgtggcgataagggagagcccggtgaaaaggggcccagaggtcttcctggcttaaagggacacaatggattgcaaggtctgcctggtatcgctgtaagtaaactgtagccatctcgcacataaactgatcctgaaggccttcagctcagaaggattttcatattttcactgctattgttccagtatagcctatataatatccatttcccattctctggctaactccatctcactcttggaggtaatgctatttcatgccaacatgaaaggtgaggattaagggagatagaaatatacatacaataaaatctcctggtaacaatgtccttcaaccccacttaaaataaacataattagaggaatgactaatattgcactgctgaaataggttgtgaaaaaaaaattgaatataatagacataatgggagaaaagagccccactttacattttcaattttctcaatccggagtccatttaactaaagtttcccattgaatttggaaaaaaaaaaaatatgtctcttgacatgtgctctgaaagtgtgattttcctcttctgtctttaaagggtcaccatggtgatcaaggtgctcctggctccgtgggtcctgctggtcctagggtaggtggactcaagagaagacagttcatctctgaaatagaggctaaagcgagcagtgagccccaggctgctgctcccttggtgggattcaccagctcacatgtacctggtgtctgtcttccttagggccctgctggtccttctggccctgctggaaaagatggtcgcactggacatcctggtacagttggacctgctggcattcgaggccctcagggtcaccaaggccctgctgtaagtatgatttggggaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttgattattttttactgatgagaacatgcttccgtgtgaagctcaactgaaaatctgctgccatggatgtctctcactgtaacaaaatataaagcctctcctatctcactttcacctttgcagggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggtaggtcaagatgtccagaccagactgacccttctcacaagttgagcttttcaaaattagtttccattgacatttagagtgaaaatgcatttgggtaaagattacattatgtgaaatcacacccaattaatggagcgtcatcttctcccaaccagcacccaacctcatttcccttaaaatgtatttttgcacttttcatagtaataagtaccctgatttgatttttcatggaggaggggagggaaggaactgtctaatcttaaaaatagccaccctcttcctcttaaatatggggtagacaatcaaaaatgttacttatgagagtcagtatctttcattagttattattagaatctgtgttctgctcaatgagaagtttcatgatctgaatgttattttcttaaaaggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccaggtgaggaatcccacaaacacctctccttctgctaaataatattttggtaggactgtttgttaattatctgcattttaatctctgacaaaaatgggcttattaaaaaaagacctgttcctttcctgggttccaattttgtcctaaattgcacattagaagatggattgattggacacatccatgtaattcaaagttattattcaaatttgacttaattggtaatcattgaaaaaactgactaatgtcatttagtgtgaaggagcactggccagctatatgccacactcatacatatgcattttcagaatgtgagcagcttttctgaatttttaatcaaaccttttcaccaactttactgaatgcctactggaattccataaattacaaaatgacagaaaaagaaaaatgtcagaatttctacctcctcattctcttattctaaagaagaagcatatgcaaaaaggattaattgaaacagataacttttttagatgaccttgcctcagtctagtaggtcttatgttcatctaggtaactgatacttcaaagacaagtgaattaagttttctttaaaagtacccttttcctaagcttggatctgagtctactcttcctgagatctttttttttcttttttttttttttcatgtttgactcttagtatctgagtccttctccacttaactggaatttcatcctattttctgtagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctgtaagtaatagtgaaatatgggaatagctttgggaagtgggatggagggggttctaacttagactgcccccaagggggggtctaaaggggggttaaaagaacagaagaatgagagaactaacttatttcataagtaaattcagtttttgtatgtattttatatttatttatttatacgtattaatttcgtacttaaattcagatgataaattcagagtattcttatcagatagtgccttctgaaatgctgaaatgtatactatgtccatgcattgttttttctttagcatgttttttaaatggtaatgtgtgcccagaacttaaaatttcttgagacttcagtggcctaaactataatttatagttatgtgtattttattttacttattagtatggcctacatttaacttttaatgctttttctacaatatgctataaatataagaaaaattaaaattcactaacagcaagactacatacccacccaggtcccgctcccaaagacacacatagagggacatacacacaacaatcctaaaaatgactttgtagagataggtcacttggaatgtgtgttgaaatgttgttggtttttttggtttgtttgtttgtttgttttttgttagactgatagggagcccctcccactaaagacacccttgatactgttatttcaaggatgaacttatttatctgggacagacatcttcagaatgacacatgccaaacagtggttcttattaaatcaaaggttcagatattatcagattcagaaatagtgatgctttgtgtatctattttcttctctttaaacagaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatattgagtaaaattccttgcttcaatgctctttgcaatataaatatgcatctctaccagccattagaccaagtgcctctgattagatagaaattatgcaaaaagggcagtttggtgtggtagaaagagcagagaacgaggacccaggagagctgaactccagttctggctctgttccttgtggctgagtgaccttgaaactctgagcctctgcatttcagtttccatagctataatatgaaaaaattccttttcagcactattaagcatttgccctactcaaaatatgtaatatttaagcaacatggcatttttgacctaattttactataaccaaaggtctatagaaacttttggtttattatatattaagcactttataacagtggctgaaagttggtctatgagcaattaatactattaactaaaacagtttcaaatattcagtaaaaatgccatacacttaaatctgaggcaactgaatacaatgcctgttaagaggtaatgtgtgtgctgtcaatcaggatagacagttgtggataatagtaccacgaacacctacctgccaaatcaagttcattttcctcccctgcacctttcaataacatctttaatacacttaaacatagtaatgtgtcaagtaaaatgttaagattcatttagagcttatttcctgttgcagaacataattgtgattgtaatatttgccttgtgttataagtcatctcaagattcaattagttttaaaggcaaaagactgaacatggtaaaaatgtaatattaaccttaaaaagttagcaaggtctcctaatcaaaatgcagattcctggtcctcatctgccaaattcagatttagtaagaaattgctattcttacgcatcctgtgaaattcagatgtgcaccaattgaaggaccacctgatgaggttactgccatagtcctttgtagctctaatattctgtgtctgacaagaaggaatatatatatctgaccaaaccatatataaagataactcctgggatccgaatgctggtactctctataaattagtaattaaaatgaccatgcaaacttacatgataaaacagaaatctctggatcaaatatgaactataccctcagacttatagcaaaaaaaaataaaacgcatttattgagtacctgctagaggcaaaagccatgctaaataataataatgacctttgtcaaactgaatctgaattagcagatttcctaagccaatgctcacttaataatcacttaatcatcatcagtgtgagacaactgaaaatagtcaaataaataatggtacacctaatggattacaatgaggaaacaaattatggtatatccagtaaacaatgaggaaacaaattacagtatatctaatagataacgataggatgaatagtgaaataaattttggtatcccaataacatttataaggatgatttaacaaaagaaaaacttcttagaatagaattttcaatcttgaaaatctaatattcaagaacactgtcattataattagatattttaaatatacatgtaaaaaaatgctgagagtaggcacatttgtatagaagtttaaggatgatttttaggcctaaaattttcaaatttgcaacaatgtagctatattacattattatttacaacaaatttactcttaaaatattatgaaagaagcagtcaaaagtgaaaagaatctggttcaggagtagccatctccagggaaggagtggtcaacctcccacccacctgtttcctgaagagaaggacaagcctggcctaagggtcatcatccaccatggaccagccatcctgagagaagcttgggagggtgtacaaagctctaccaggccacagcatcttcagggagctcagggagcttatagtgcggttccagaggcagaataaaataatgtgtgaacagaattttaaattacatatcctctgaggataacagaagacactattaattaattagagggagtctcggg

SEQ ID NO: 11754 - DNA, 75394 bp, Human
  misc_feature (1)...(75394): n = A,T,C or G
actaaatatacaaaaattagccagggtgggcggggtggggagcctgtaattccagctagtcaggaggctgaggcatgagaatcgcttgaacctgagaggcagaggttgcaatgagctgagattgtgccactgcactccaacctgggcaacagagtgaggctctgtctcaaaaaataaataaatacataaccctaggagtaggtactactattgcaatcatcccattttacatacggggaaatagggaggtcaagttacttgcccaatgacactctgataggaaatggcagagatgggcctcactcttggcctcctcactgtgctgccagagctctgtaggagttgagggaagtagaaaatacagcaactaagatagtcagtgaaacctccataaaagaggacttaaatgttgaataagattcagatgaacaaataaaattcttggcttaaaatctttccaaggctccctgtgctttgagaagtgaaacttcttggactgacatacaagtttattcaccacttgcacttggcctgtctctccagccacatgacatttatgtactcaataattaccttttacttaataatacctatggactaggcattttgctatgccttgattatacagaggtgaacaaagcagactttagtttcctagtcatgatgaaagttacggtttagtgggggaaagacacataatgggtccataaacattttccatttaggctaggtagtaagtatcttacgctttgtggctcacatatggtccctgttgcatattcttctttgcttttgtttttaacaaccttttaaaaatgtaaaaaccgccaggcgtggtggctcacgcctgtaatcccagccctttgggaggccgaggcgggtggatcatgaggtcaagagatcgagaccatcctggccaacatagtgaaaccccaactctactaaaaatacaaaaattagcgggcgtggtggcacacgcctgtaatcccagctacttgggaggctgaggtaggagaatcacttgaacccggaaggcggaggttgcagtgagctgagattgtgccactgcactccagcatggcgagaaagcaagactccgtctcaaaaaaaaaaaaaatgtaaaacccgtctttaaccctaaagccatacaaaaccaagccagattcagcctgaaagctgtattttgccaactcctaaaacactgaagtaaacaaacagactaaacagtatatatctttttagattgcaatcaatgacataaaaggaaaaaatgaaagttgtaaaacaaaacaatctaactccctgatactcatcactcctttctacatgctattttactctctgggaatcctgtctcattccagaccttcttcacccaattagttttcatttggtcttcaagactgagctaaaaaataccacctctttcagaaattcttcccctgtagtatattgtgcccaactctagtatagagtttatcttcctggatgataattatttgtttacttgcctgtctccccagttaaacactaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaaatgttttgcccacctcagcctcccaaagtgctgggattacaggcgtgagccactgcacctggcccaatgactatttatgaacaggagaagagtatgatcaaagtcatgttttagggaaagtggaatggtttcctgggacgtttatgagctttccagctgggcagaactggattcaaatccaagtgttattaactgattgacactgtgattctggcctttgacttacctaatactttataaattataattttaatacatggattgagaatagaatcatctagatgagaatactgtagtggataacactttgtctttactattaaaaaatgaagaggtatttaggctgctaattcttaaaatgttgttttaaagagtacatattaagatcattgctagtgttcattgaggaataacttatgccaggcactgtgctaatgcttgacgcatattatttcatttaatcctcttctttaagagacagaagcccaaatccgcccatgctcttaacatatatgctatatgctgtactacagtaatatgccatcggtttaaaccaggatgtggatgggtctgacaaaattttaacatgaatttttgatgcctggttttttgttttgggtttttttttttttttttgagatggagtctcgttctgtcgcccacgctggagtgcagtggcacgatctcagctcacttcaacctctgtctcccaggttcaagtgattttcctgcctcagcctcccacgtagctgggattacaggcacctgccaccacacctggctaattttcttgttaatacctggtttctaacttcaggattcgcaggaaatccaggtgagaaaggaaacagaggcgttccagggatgccaggtttaaagggcctcaaaggactacccggaccagcaggaccaccaggtacagctgattctcaaatagaaaaatatcacattttacactttcctacatctaaagtaataaaagttgtttctaggcttactgggtttaaatatcaattctgttctgatagtgttccagcagaaatttgctactaaattaactaaaagaaggtgttgatagttggcgtgtcattaactaacatacattaacctacaaatagttccattttgtcctcaaaatttcattctgaaattgctgatatgtattataaattataatgtatcactatatcacatatcagagatgaaaattagagaatgctttagaagttttcaggtttgcatctttcttttttaaaacaagtaactgagtttacaaaataatttttaaataattaaagtatcccaccattcctacaaccatctcagtaacaaaatatatgacatggcaataacacttcaggatgcagttggaaatgtattaccatatgtttgcaggagcccacttttttcccgctggtgttggtcctaggatgattttagtgtttgaaacccaggtctgctaacgagaatctaactttctttagttttccatgttccaggtccctagttccctcttatttgaaggaaaaaggacagctagacaagtgcccaaaccagccggtctggctgttctgcattcattcatgcatgcaagcaacaagtatttattaaacacatactatgtccaggaactgtgcagggcaataactacttatttgttctcaaggccccagaggagatttgggcagcactgggaatcctggagaaccaggactgcgtggtataccaggaagcatggggaacatgggcatgccaggtaatgcataaggtcctgttatgagcccacaagctcatgatgggtgaggactccagattttctgtgttgtgtactgttttggttttccacttggtagaaagcttatattaaaaaactagatttgcggggccgggcacggtggctcatgcctgtaatcccagcactttgggaggctgaggcaagcagatcacctgaggtcaggagtttgagagcagcctggccaacatggcgaaaccccatctctactaaagatacaaaaaaaatagctgggtgtggtggcacatgcctgtagtcccagctactcgggaggctgaggcaggagaatcgcttgaacccgagaggtggaggttgcagtgagctgaggtcacgctgctgcactccagcatgggcgacagagtgagactccatctcaaaaaaaaccaacaacaacaaaaaaaacagatttcctattagacaaatacacagtgtgcaaccagaaaatgggtgagaacaaaataaatattgatattatataataatcatctattgtaactacctgatgcagttgcaattctgaaaaagccattcttgggagaaagcttatgtaaaactgaaaagtagaaaacttcaagatcctcatgtttatctattttactctatgttttccccctaatttcaggttctaaaggaaaaaggggaactttgggattcccaggtcgagcaggaagaccaggcctcccaggtattcatggtctccagggagataagggagagccaggttattcagaaggtacaaggccaggaccaccgggaccaacggtatataggccactgaaatatttacattttagtggtggagtgagtgccttgaaaaatatcaacaagtacccagattcggtgtgggcagagaaaattgaaactgttactatactttcagacagttatttggatttttaaaatcctatctccacaacagaggatgcttgtctgtcacagagctgtcaacttctgagagcctctttcagtcaccaaggaatttctcacactgtctctgcaatttaggtgtgctgccagaagaaggcagtgattacaggcccatacaatcagataggacagtgggttttttcttgtgatacaaagtggcccatttctgctgtactcatctcagacttagaaaaataaatttccaaaccttctaataaaaaacacttgtcggccgggcgcggtggctcacgcctgtaatcctagcactttgggaggccgagacgggcggatcacgaggtcaggagatcgagaccatcttggctaacatggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaacaaaaaaacaaaaaaaaaaaacaaaaaaaaaaacacttgtcttacaaagactaacaaaagatacaaaataaaataactttacagcatcattagaaagcgaacaaaatcctaagatagatacatttatctttcttgttttagaactttttctgtgtaatggaatggaaatgcttaatcttgtttcaatgttttcagtgtttgtgctttgtcaaattgaggttggatgttaaagcccttactactgtattatacaaagcagcaaccagatgtttcaatagggcttggctgctttcttaggtttattctcttcccaattttctgagtacagctctcacactaaaagccagagatagaccactagagaatgattaatagaagttcctataagcagaagttgctaacgtgggattccatggaccactgggaaaatctatgggatcccaagaagcccagcaacctcttgaaactaaatgcaaaatgtttgaaaatgtttttgtagggtagagtctatttttcagatttagatttttagattttcaacagtatatgtatgactccaatatataaaaagtattacttagggaaccttctccctctttttggagacaataaaataccacctttcctaaatatttccaccagctatagtctccagtagtaactgctaaaacaagaaaaaaacttagacactacacagacccaagaaagcaactgtttactacttggagcacagacaaatgtctttgttctttatatttagattaagtcctcagaaaacctgagattgcttccactgagatatttgctcaacgaaaaatcctatttgacttcacactcaattaactgatagtttcatttagatttaaagttttcacaggtaaccaccagaataaatttttagaactgtgcattgaacacaaaatgagctggttttatcatgtcagcaaaatgagagtaacagagtagtatattttaattggctaccatagaaattttgtaaatctttatcaaacctatatgttcgggtttgtcgtaaaactgaagtgaagatttaatgaacactaaatcattggaaggtttttaaaacatgtgattgacatatgtgcatgcatagcatttgtaggatacatctttatttagtctatttctttcttactcccagctactcatcacaatttgtaattatatatttgtgtgattatttaatatctatctccttactggtctctgaagctccatgaaggcagggactgtgtatgtcataaatctatataggttaccattatatcctggtaaaagccggcttcctgggtatgctaccagtgcagtcacagaaatcctgtgctaagaagggcctccacacttggtctgacgctatgctgttgctgtcttgaaattcactttaaaaagttttaagggaaactgcattttcattttgcactgggccccataaaccatgtggccgtcttattcccagcacctatcacagtgctggcagatagcagatactaatatgaattgatgaatgaatgaaaaaattagtgaataaagtttatgctgaattcttaccacatatcctgcttatatgagaattttaaaggtatttgactacatttaagggggatccaggactgccgggtgatatgggaaagaaaggagaaatggggcaacctggcccacctggacatttggggcctgctggacctgagggagcccctggaagtcctggaagtcctggcctcccaggtaaggcttgagtttacaattctaaaagctggaagcattactcagagtatagccctcctgaaatcattgtggtaaacagaaagctatttatacttttatgctgcagttgcttttattcaactttgaacttcaaattctaacacactaagagaattcattaagagagcccaattttactaatcagcccatttggactgaaatacaaaaatatgttcctataaaaaacacttttgaagaactgcctcaacaaattcagcccaaggatacaaaatgttagccgttatacaatcataatgtttgtattagtttgtccaggcttccatagtgaattccacagactaggtggcttaaactacacttgatgttagccaaaaggctgagaagtgattaggtggcttaaactacagatgtttattttctcacagttccagcagctccgagtctgtgatcaagctgtcggcagcgttggtttcttgtggggcccctgttcttggcttgtggatggctatcttcttccagtgttttccaagtgtctgaatcttcttttcttataaagacaccactcacattggattagggcccaccctactgacctcattttaatttaattacctgtttaccagccctatccccaaatacagagtcatgttccgaagtactgaaggttaggacttcagcatatgaatttggggacaacacaattcaaactacaacactgtgctgtgactctttttcgaacccatttctggattgaattttggctttctggcttattagcttacaattcaggtttagggttttgttttattaaaaacaactgtgaaactatcgggttgcagattcaggtcttacttaaatacaataaactacctgttcaaatacagaaagtttcaataaatttgcatttaactcgcaattaaaataaaatcgcatattgagtggtgcttgtggttggtgtacacacatctttgaaagtgattagacacatctctgcactggttctccaggaaaattgcagcctggacaaaaccatggggtgaccttgcaacaagagagcttccttaaggccagcgtgagcatggttgactataaaaacagaccgtttcagtcactgttgtaatcatttatcttttggtgatcttttttcttccttcccctctcttcatttccaggaaagccaggtcctcatggtgatttgggttttaaaggaatcaaaggcctcctgggccctccaggaatcagaggccctccaggtttcatttttgtactttctctttttccttttcatgtgggagacacatttttctcctgaggtttggatttctgtaaacctactactctatagaaggtagctcctagttactcagtatccagacaaaaatgcaaaaaaaatggggttagatatttctatctatttaattcaaatatttggcaacctattccaaactgataatcctcatgataatagtaatctgtatgtggttttccctgggaacatagcttcacatagctacagttctgaaaaacagcctgtttaacacaattccacacatctccctggtattcccattaggccactggcaagaaataaatcctctttttgtataccatagtttggggtttttgggttttttttttttttttcaggtcttccaggatttccaggatctcctggaccaatgggtataagaggtgaccaaggacgtgatggaattcctggtccagccggagaaaagggagaaacgggtacaacttgctcattatctttgatccgttagttttattttggatagaatcattagtaacagtgtaatcctttgctgctctaaagatttttctctgatagaactgattatctttaacatgttttcggtgtgtactaaacttttctcatagacatataatgtaatgaaattgaccaattattaacatgccaagattatctctttcaggtttattgagggcccctccaggcccaagagggaaccctggtgctcaaggtaagcagttcttcttccctgtcctaatgtacacattttcaaggagagaaagcagttgaatatgcttgaaatataaagtaagcttaacctagtgaattaaagatgttccaatagtaatacaggatatttatcatcttggtcttcaatttaaaatgtttaattattaccatcacaacaaatggaatgaattagaaactgtgattcaattttggaatttcctactaagaaagtcttgaaaagtaaaaaggattcttctgtatatgtcttgctgttgttagcatggtttaaagataccacctcctaaaaggtgaaggtggaactgatgggttctcagtaagcatctgtccctgctgttctgagacacaggagtaatccgaatcctttcccacctgtatcttcataggtctgactccaacccccagatccagcttgcggtccatgctattgtttattaaaggcgacccagagagtctctcaacatctcagacatggcagtttactgaacatgtcattcagagtatttacaagttttttgtttggcaggccacagatctggatttctcatgtcagtgctttacaagataaacagcttcttttaactcttttccattttctagtcaaaccttccaggagaaacatcagattgtttgcacatttcattgacccgtctcagccacgcgtcctatgaatgggagcatttcattagcaaagaggcctaacacactgaagggctctagttattgatgttcacgcaaaccagcaaagagcagctggatgccaatgagaaactcagttgggcaggaaccacctcttgacaaaacagttaaagtgtaaaagtagacaagagctgttctctcccatttgtttcttactggtttgattgttctttcggttgagctcagtcttcccacatctctcagacctctcctttcccaatgaggatgaaggctcttcctgttccacagtgtagctttagaattttggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggtatgaatccttttaattagtttattctcccaaatcctaaaaagaaatcatattgcagagcatgtaatcattttaatgaacatgaaatatataatccaagccatcttggtacttcaggtcattgccatgcaaatacagtattacaaagcttggagtgaactgaagtcatctaagcactttcttttaaaagcataaattacaggcattaaaaagctaaaggatgtgaatagacatagggctagatcgtcaatattcatcaattttattttcattgtaagtctttactatataataactccccaagccctcccctgagctattagcctccctctccttctccctctccttctgcacatctatcttccgttttcatgccatttactgctgctagaataacacagagatgggagagcagagggagacattatttgcaattcatacaatatttttcattcatgaatgtcaaagcacaatttcttgaaggttttctaagatgaaaaatattagtattaacctgtgacctttttggagggtctttggtaaatccaaacctcctgccactagtattcctattatggggaatgtgtggggaagttaactaaaggacagaataaagactgcaattttgttgctcctttgtctggatttagctggataatacttcaaatgcacacatcagtgctacgcagtttagcttcttatgctctaatgaattatcagtgactcaacaatgtcaacatgactaagttaatcagctgataataactggcttatatttatataacactttagagcttacaccatgcttttatgtctgtatgttatctcacttgatctgaaagaattagctagaacaggtattaccttcattttttaaaataagaaaatcaaaatttgtaatagtaggtaaatctgaagtgactttgccaagatcagacagctagttggagacagactgagtctcaactcagtttttgtagctctatattgcatttaccagcaatatattataaaatatatattttagaaacatatattctgaatctgaacacttttaagcaaagtacctacattattaaagatagtcaagaactctaacccaagcatatgggcattaaagaaacttattaagccttcttctttgcaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtaaagggtttacttttaaacagcataaaataacaaaaatcatgtttgacctcaaaagttttcaacctcctcctcatgttaccttgttgcttcttctttccctgtggtcatctccattcccccactacctgtggttcccatacccagcagttgtcaaggcaaggtagcctgtttgagggatgcatagttaataaattaacgagcctggctggacgcagtggctcacacccgtaatcccagcactttggtaggccaaggcagatggatcacttgaggtcaggagttcaagactagcctggccaacatggtgaaaccctgtctctactaaaaatacaaaaattagccagtcttgcttggtggtgcatgcctgtaataccggcaactcaggaggctgagatgggagaacctcttaaacctgggaggcagaggctgcagtgagctgagattgcgccactgcactgcagcctgggcaacaaaacaaaactgtatcaaaaaaaaataattagcctaaaagacagtgatgcattcattcaactctatttgttgaatccctagagctgggctaggctctagggaagcaggcacagaccctgctgtaacagaccctcactggggagaagcagatcctgctggtgggtgccaggtgcttcgctggcatcatcttctcctgtctttaccacaatcccatcacatgctccaggggaaagaatgtttgtggcaatgctaagtgaagggtttatacttcattagaaacaatcactgataaatagaaccttccaagctccctggctggcaatactgacagacttttcatgaattcaggtgcgcctggtccccctggacctccagggagtcatgtaataggcataaaaggagacaaagggtctatgggccaccctggcccaaaaggtccacctggaactgcaggagacatgggaccaccaggtcgtctggtgagtatggataattattttgactcattattaattcaatatcaacttataattattcttatattgtatattatatcatatattgttgatgttaactgtattagtccattctcatgatgttaataaagacatacccgagactgggtaatttataaaagaggtttaattgactcacaattctacatggctggggagacctcaagaaacttataatcatggcagaaggcacctcttcacactgcaacaggagagagaatgagtgccaagcaaaaggggaagccccttataaaaccatcagatcggccgggcgtggtggctcacgcctgtaatcccagcactttgggaggccgaggcgggcggatcacgaggtcaggagatcgagaccatcctggctaacatggtgaaaccccgtctctactaaaaatacaaaaaattagctgggcgtggaggcaggcgcctgtagtcccagctactcaggaggctgaggcaggagaatggcgtgaacccgggaggcggagcttgcagtgagccgagatagcgccactgcactccagcctgggtgacagagtgagactccgtcaaaacaaacaaacaaacaaaaccatcagatctcatgagaactcactcactaccatgagaatggcatgggggaaaccacccccatgattcaattacctcccactgggtccttcccaggacatgtggggattataggaactacaattcaagatgagatttgggtggggacacagccaaaccatatcattaacattgacttatcgttagtacaagagtactattatactcttataaattaattgccagatcagatgggcctggaggcagcaaaaatttacaatttttgatgcatctgtgcagtgtgcctaagggaacacagtccagaagtttctgaaaatcaaaaaatcttcagagttggaatgatttggcctctaagaggcctccaaaactttggtctgtatgggactcacctctacagcattccagatccttgcttatttagaccctgaacaagtccagtgacggaatcttcaaaaagcagctgggagttcagaatcactctaaatgacattgtcacttttccctctacttacaggcttctgaagatttctgcattcccctgtaaatgcctatttattttctgccccccaaatgcctgccaatgtttctaaataactgccatttctttccaattattttattcctggataaatacttggttctttcaaattcagtttaactatttatcagccttgcctctatactgaatacaccctagtttcaatcgccctaaaaaatatagcctctggaatgaacgccctccagaagtaagaagtcaataccccagtgagtggctaaaggacagaagggtctactgtccggaacatcaccattttaggaatcagacctaaaattccacttgggccattgggctgacctacctgtctccacattgtgcctgtaatcaactaaagcccatgggccttttcctcatgaactgctactaagttttctccattatttcttgcctagcttgttgttgctgatgtttatttgggacttaagtgtagaacttttacatttatcaatcttagacatcatcttattcatttaggcctgtgccccaagcctgcaatctctcaattcatattctctctctcaacaccacagccgtcgtccctagctttctcttagcagcgtattagacaagttgacccctctgtttacatcaaatccttggagacagatgttgaatagatgaatgtgactcagggatcataactgagtgtctactctgtaccaatggatagaaaaacaaaaagctacagtcccttgccctagaggagcccacaataaagtgagggtgatagacacagagacggccattttcacactgtgtggtaggaagaatgcagggggctgtggggacacagaggaagggtatttaatccagactgtagagggaaggtgttcaggaaaggtccctccccaaggagattgatgcctggcctgagtcttgaaagacgcataggagttatccaagaaaataggaaaagccggggtatgggtcgggtggaggaaaggagctttctgagcaaaatgacaatgggtgtgtgtgagtgacacacacacaactctattactggagctgaggtgggaatgaggacaccttgggaggagtctggagggctaagcaggagtcaggtaacggaggtctggttttctagactaagaagagggaggaggacatcacttgctgatccaagaaacacttaacaaagcagctctttgtgcccagagtttgctctctaccagctggaattaatcccttaatgaactgccttttgatgtggctattcaccaagctttaaatctatccttgttgctctatgcagcagccattttgtccacaaaaatatagtagagagagctaccatggcacatggcacagctctctctaccatgtaaattgtcagtgtaaatacattgacaattcatatgtaaatacagaacatctatggtataactcattttgtcctctactaacctcatcagtgatgcgtaatgaggtgctttgccatagctcattgttaggaatcgctcttaagtactcttggtatttgatttccagaatctaactttaaaagtttttttgaaaaatgacatatttgcccatcttcagtctgtaggtgtctctcatgttctccatgattctttgaaagttgccaatttgatccatgattacatctgaagaccttccaaaggacactgggatatataaagcttggtttggaaacatgatcttacttaactcctctggtgatttcgtggtcattcataggcttctatacttacagttgaaagatatttcttgatggatgtctcaactggcctggggcctttaacagctccctcctgctgccagggataaccctggcaacatgccctttttcatagttaccttagcctcaagagaacaggcagacatcagaagccagcaagtccttgaccagatggttctgttttgtctctctccttttttaacaacactttatccaagcaatcagatggttccttctttggtcttcttgctccaaagatagctggttcaaggccagttttatccttggcacttttcatgaccttcaaagcacattattctcaggtaatagcattatctcaattcacatggacagtatgaaagtagatttagcatacattttgacaaatagctctttccagaagccctgctccctcctccctccttctatggctttgcttgagcatctcctggctataagaccagttcatgtgagcctcacaagaagagagcacctcgttcctgcttagattattgcatccttgtcaaatatgcctgtcaaatactctctcttgacaactcctgtacactcccatccctagacattacttctcctaccatcatgatcaagtgtaatttatggctctgctagcttagtgagaatgaagcttaggtgctgtaactcaacaacggttttgttgtctttgcagcaattataaatacagattataattttcattctgggccaggcatggtagctcactactataatcccagcactttgggaggccgaggtgggcagatcatttgaggtcaggaggtcgagaccagctgggccaacatggcgaaaccctgtctctactcaaaatacaaaaattagccaggtgtggtggtgcatgcctataatcccagctacttgggaggctgaggcatgacaattacttgaatgtgggaagcagaggttgcagcaagccaagatcatgccactgcactccagtctggaggacaaaacgagactctttctccaaaaaaaaaaaaaaaaaaaaaaaaaaaaaaaaaaaaaaaaatcattctggcagtactgggctactccatttaggacacagaatatccagttgaatccaatactaaaacaacatacaccaacattagaaggtatgtttgctgttgggcttaagggaagcttttattttacttttaaaacgatagtcctaaggaaaggttctaagtggccagaggagttatagccttgattgaaagataaaaatgatgtctgctaacttcagcttattctcacccaacataatattataccctatttgcatttttaaaaaactgctgtgaattgagtgattttaaaaatttgttttggttctgctccctttatttgaaatatagggagcaccaggtactccaggtcttccaggaccccagaggtgatcctggattccaggggtttccaggcgtgaaaggtactggtttttgtgcattgctctttatatgcaaataccataacctcaattcatattttagggcacacaagtgtttgctgaagtacagacagctggggttagtacaaataggacctcaatacgagtgaagtaggaaggctccactacactatttcaagattctttgaaatagagtatttcttcagatcaatggctctcggtaaccttcttttatttgtgtaaaagactgtgattggaagagaagtcttaccactttattagttcacatcaaagcaaatattctctatgtgctgaaaagaactcctaacgtaactaactctaggctattagtaaagctagagtaataagctgagaaagtaggtaactatgacaaccaagcaatataattcaccacatggtagaacaggttttaatgtgactttgtatgttaccgtaaatatcaaattggtttctgaactcaaaaagtggactcttagggacccttccccttcaatgttaaaatacaagttcttaatgcctacttctggaatatatttctttacagactcattaagcatgacctactgggtcccagtgacatgccaaaacctatgtgaacaaaatgaaattgtagcccttgtgacagaacccataggacagagcctccaggcacacttctagtatttgtccttagagtcaatcatcaacctgaagaactaggaaacccattgatctaagtggaatcacactgtgtctttgtttgtttttaggagaaaagggtaatcctggatttctaggatccattggacctccaggaccaattgggccaaaaggaccacctggtaaataaacgtccttactattgctgtcaatgaagaaaggtaacacatccgtgaggccatcatcttcttcttatgtttatgtcaacaggtgtacgtggagaccctggcacacttaagattatctcccttccaggaagcccagggccacctggcacacctggagaaccagggatgcagggagaacctgggccaccagggccacctggaaacctaggtgtgggactggcagcattgacttggatcactaggaagtggttgaaccaaaatacctgtaaactgctttggaaacagctgatacaacttcacagaaaatgttgaacatgatagtggttttcacaatcagtcttaggattgagctcattttacccttgaccagcaaataaaagaccttggaatctattgaaagcagttgttcatagtataacttgaacaaatacactttagggcagcatgttttttttattattttttattaaggtaaaggtatgtctatctcctctgacaactgtcagtctcggggctctatttctaaatgattgtctgaatatacctgagttctgtgaatttatacttttctaacatttggtacagcaaagtattaggaaaaaatgatttagaaatcttttcaaaatactggtgtttggaaattgaactaacccctctacatatgcacagcatatcgtaataggcttctgaatggaatgattatgccttaagtttgtctgaatcacctgggagataaagatattacttatttgtttgatcaattcagggacatagtgaattctggaagaacataaataaaaattgcagcacaattttaaactgctgcatttagtatcctcatagttcattttcgagagtcttattttctgggaagtggggctaacaagttaggtgactaatcatcctagcttgcccaggactgaggatcttcccaggatgcaggactttcattcctgaaactgagaaagtcctgggttaacgggatggttggccaccttacttttcatcctatatgataaaatgcaatacaatgttggtttttgcctaggaccctgtgggccaagaggtaagccaggcaaggatggaaaaccaggaactcctggaccagctggagaaaaaggcaacaaaggttctaaaggagagccaggtaaacccccagcttgtttcctcaccgaagaagtgctatttcgacatacagagaagtcttgttcgagtgggtgactatatgagttatctaggcctttgagtttatgttgttcagatcagaccaaaggccaaggatcaaatgttcatttggaagatgagaatcaagaattattggaacacagtatttttccgacctcttagctggtcagatgggctccaaactgatgcacagtttagcctgaggacaaatagaactaataagtcctatgggtgttctttcaaaaaggccaatacctgtttttaataacttataggagttgttagttaataattatttataggagcagtacataagtatgtagctagaaaaatattaccttggtatgagtagaagagcaacttagtatccttttttaagaaagccatcttttaaaaatgccattcttcatggtggtgggtgcctgtaatcgcagctacttgggaggctgaggcaggagaatcgcttgaacctgggaggtggaggttgcagggagccaagatcacaccaccgcactccaacctgggtgacagactctgtctcaaaaaaaaaaaaagccattcttgaatagaattcaacaattcatgcgtgtcctgaaaagggacctcttaagtatagtgttttattctgaacatatgctgtatgtgtcagtttgatacctggatcaacatctaccttctgcagatgtttcaaagcactcttctggaaactacctcgatatccaaatcttctatttttaggattgctgactttgttaaagcaagaaaaaattctaaatgtgctttctgaatttactgacatatatcatgctcagatctactatattaaaatggtaaagactatagacttaaatttttaaaaattcaaatatgatgttaatataatactaattgcataactacatgtgatttaatattgtcataggtgcacagtagagtgctattaatcattcaactttccttaaagtgtggtttttgaagtgataaaccattcttattaagaattctattaatttaaaaattttaatgaccaaggctttaatgccctaagaatggggcaacagcaagagcaagggcactgcaatataaattttgtagagaactaattagcaagtagacagttcaatgctatggaggcctcacaagaatgacaaagggatctaagagtcaaactgcactggcataaactgatagccctggcccctttcttggagatacagaaatgcattggatatcacacatttgtataaaagctcacttccagttcctgccctgctcagctaatcacttcccaattcctgtgcagagatgaggagacatcttttgtttggggccaactatagctccctctgaatgagggcaggggttaggaaaagagaaaaatgtgtctccccaatatattaaaaccatggcaacttggatttttcaagtaagacatcagaccggagaatttggatgtggcctatttttaatttcaaaaaaccactcaaggtccctggaggagacaagagtgggcagaattcagagaaaattgaaaaaatgcataatattggggcttttacaaatttctgaggaaagtcctgacttccgagtcaggactaaactgtgaccctgcctgactcccaggggcacggatgtcccaggggcaacaaaactaattcctgtgatgatgtaggcccaaagtctaaccatcgctgttttctctgtgattccttaggaccctagagaaccatggcccaagtctggttggggagggagtcagcgtacagtggcagcagaaatggatgggagtgaggaagtggtagccaatgccaataccataaataatagccgttcaatgaaagaaaggagaaggaagttaaagaggaatggaagagaggatagctcactggttctcatctagaacacgacaagtgtggattagccttgtccaaatccatactccaaagtatagaaagtttttctccacagagagaaaaatgtacagaaacgatttactttgtttttaactcatataaataaactaacccttattacagtgaaaaaaaaagccttctcttcttacttgacttacaaattgatcaaaacttccttgaagtttgaacctttaaaaagagctttcaatgttttctgcaattgtttattgtagacaatgttgcaataatttgtgaatttatcaaaaccataagtaatttttgttatctactcgaatagactaagttgtagatatttgatttttcccccatcacattgtaggaggattcattcatttattcataaaaaacatacataagacctaccagatgcaggcaggccactgtgccaggcctcacagaggaattcaaagataaagacctgatctcaaaaaacgcatcaaatatacacaaacattgataagaagaggcactgtgtgataaactgcttaacatttaataatactgtttggccatttttataagccactcttctctaggattgctttcaatttatgggctcaacatatataaaatatatttaaattagtactttgaaaaaacgagtttaagatttttgtgtatgttgcaacatttagaatgtgttttttgaaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggtaatgtcccagtcccagttgccagttgtgctgttccacatgcagattgtaaatctttatagcctaggatgcttccctctgaagttaagtgtaaataaccttgagtgtctcctgatacattttaaagagagcaaataaaacactggcctgtctaattttcattctggaatgtaaaatggtggaaggagcctagctcaggaatgctagcctagctcctcccattcagtgcaaacaatttgcccctaaaactccctaaaccacctgtctgcatttatctttttggtgctttttctttttcttttttctttttcacacagggtctcactttcatcacccaggctggagtgcagtggtgcaatcatggctcactgcagcctccacatcctaggctcaagccatcctcccacctcagactcccaaatggctgggactacaggcacacgccactataccaagctaatttttttgattttcagtagagatgaggtctggctatgctgtcaaggtttctctcaaactcttgaactcaagcaatcctccctcctcagcctcccaaagtgctgggattacaggcgtgagccaccatgcccagcccacccatttgcttttcaatctcacaaataactgcttttctaaacctttatttggttattagctattatgtacatatgaataagtgggaatactttgaagcaaaaacactatcccaactgatctatgctagcccccatgttctaaatcgattagaaagagccaccggaagtattaaaggtgggagaaagaagatttgtttgcctattggatctttgatttctatcagtatgaaaacttttcaatactacattttgcagataactcttttgtgttgtctttgtccagcttttgctgcaggttacatttaaattagcttctctctagtaacgatgctgaaaataactttaacttactgaaagtgatactcagtctgatgtttcattaggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcaggtaaaaatccaatcccctagttttacaatgggaccaagtgaatcacttcccttgtaatggaatgaaaggcagcacatgacagtgcagaaagtggcaatgccgccatagtctttgtttcatgttacagatgcactgtttgtgaaggtcctgcgatcgccatagccgttcacagccaaaccactgacattcctccatgtcctcacggctggatttctctctggaaaggattttcattcatcatggtgaggagaaaaggaacaggaggtttagggtaaagactacctgtagaatgttacattgtgctgggtaaaatgtgattcccagggtcgatgctgcctgctgtccgtgtgtgcaacatgccatagacatttccttgaaaatctacaaacagactttttttttttacttttggtaaataatggagtactaaaaaagacttctcaggaggagattacctacaaattctattatgaaatttaggtgaatagtagctgcgttttattgataatggaatgtctctttttattattttttttatcttttgagacagattctcgctctgtcacccaggctggagtgcagtggagtgattttggctcactgcaacctccgcctcccaggttcaagtgattctcctgcctcggcctgctgagtagctgagattgcaggtctgtgctaccatgcccagctaatttttgtatttttggttttttgtttgttttgtttttttagtagagactgggtttcaccatattgcccaggctggtctcaaactcctgacctccagtgatctgcccaactcagcctcccaaagtgctgggattacaggcatgagtcactgcacccagcctggaatgcctattttttataagataactgctttacatacattctctgtaatttttatgaaaacgctcataggtaatttctatcatttacagttttacaaataagaatgaagtactttccccagggtcttacaactatttagtggaaaagctaggatctgaacccaggtctatctgctccaaaatctgtgccccttttgacattcatatggagataaaagcaaagaaaaacagtcttttaaagaaaaagctttcagatgtaaatgctagtgaagaagtttatggattggccatgtgtgactgtgatgactgtcatagctgcacgcaggtggttctttcttttttctttttctttgtctcttgagacagaatctccctctgtcgcccaggctggagtgcagtggtgcaatcttggctcactgcaatctccacctcctggctcactacaatctctgccttctggctcactgcaatctctgcctccagggttcaagcaattctcttgcctcagcctcctgagtagcttggactacaggcacatgccaccatgccggctactttttgtatttttagtacagacatgatttcactatgttggccaggctggcctcaaactcctgacctcaagtgatctgcccacctaggcctcccaaagagcgagctgggattacaggtgtgagtcactgcgcctggccacataggtggttatttctaatctgtagcatcgctcatgatcattcctcccctttctttactcacagttgcccattcattcaaaaaaaaaagtagagaattgaaaatttgaaccccaatggacagagtgtttattcagatttttaaaattgtggtagttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcaggtaactattcaccatcaagcttaatctgatgactcaattgcagaactattcaaaggttgcctgtgttcttgggtcaacgagtagccatgattttgtactactgtgccaataaagacaaaatatgggttttgtcatcactaaacacatttaatatttgtatatgaatttatagtaaattacttgatacaatcacaaaacgatctctcatctgaatttactgtattgaaagacttgtgaataatgtggataatttaaagggtgggagtagtttttattaccaaaaagatgatctataagttttcatcaaggcctatgtttctttaatgctgctgaaatatgactaaaattataaaatgccaccatatataccttttcagaaatatacttcttccataaagagaaatagtccattaatataataaatttctctcctttttttttttttcttgagatggagtctcgctctgttgcccaggctggagtgcagtggcgcgacctgggctcactagaacctccacttcccaggtttaagtgattctcctgcctcagcctcccgagtagctgggattacaggcgtatgccacgacacccatctcatttttgtatttttagtagagattgggtttcaccatgttggccgctggtctgaaactcctgacctcaatttatcctcccacctcagcctcccaaagtgctgggattacaggcgtgagccaccacgcccgaccctgtaataaatttcaaaatagcaaaaatattcattaataaaacaaactcagcaaaaattcccttttatgcataaataaatgaatttttttggtttgtttttatttcagaaagcctattccatcaactgtgaaagactggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatannnnnnnnnnnnnnnnnnnnnnnnnnnnnnnnnnnnnnnagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacagaatcagaaactcttgggggagggcccgaaatatctatgttttaccaagcccaccacatgattctgatgtactctaaatactgagaaaacctgttctagacaaatacccaagcaacaactccgcaggcagttacccagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattggagctggtccttttttttcaaaatggaaataaattttttttggattgtaagaataacagatgttcactgtaaaaagaatagacaatacagaagttatgaagaagaatataaaaatggccatgatctaatcctcactcccatccaagataagtgataaatctatttttaaacaaaaatgagataaaagtatgctattttgtcaccaggattttttttttttttttgagacagagtctcactttgtcgcccaggctggagtgcagtggcatgatcttggctcactgcaacctctgcttcccgggttcacgccattctcctgcctcagcctcccaagtagctgggactacaggcgcccaccaccatgcctcgctaactttttgtattttcagtagagacggggtttcactgtgttagccaggatggtctcaatctcctgaccttgtgatccacccgcctcggcctcccaaagtgctgggattacaggcgtgagccaccacacccggccttttttgtcaccaggtttttaaaaacttaatacatagtgggcacattttcacaccaacagacaagaattaatcatcatttgcaccacagttcattgcatgggtttataacctaagataataaatccccaattgacagacatttaatttagttatattatagacatattgtacctatgtcaccacaagtttgtccaattatttcttcaagataaatctctagaaggaacactatagagtcaaaggtctcacataatctttttatatacaaaaatgctctccagaaaggttgctagaattttcagctgcgtcaaccatgtaatgaaaacactcatttccctattaatttaccaatacagactattgctgttattttacatctttgcctatctcattgcagtgaggcagaatatttgtcacttttaattagtgttttttttttaatcaaagaagtattttgatgactgcctgttttcctgtgaagggcctaatcatatctttgcttatttttctattgaggtattaaaggagtctttacaaatcagtaaaaaaagcatatagattacagaaattatgggtcatatattttgatacatgtttcccatttataatacaaatactccttattcaaggaaaacaattcataaaatttcagatgtggagagttggtaaagaaaaaggtttttaagatgcaaaatataggctgggcatggtggcttgtggctgtaatcccagcactttgggaggcctaggtgaatgggtcacttgaggtcatgagttcaagaccagcctggccaatatggtgaaaccccatctctactaaaaatacaaaaattagctgggcatggtggcagacactgtaatcccagctacttgggaggctgaggcagaggaatcgcttgaacccgggaggcaaaggctgcagtgagccaaggtcgcgccactgcactccagcctgggcaacagagactctgtcttaaaatacatatacatgcaaaatatgaaatatcatagagaaggaactttcaggctgcattaaatggcaataatgatataatcaagggaagaaatggaatgaatagtgatccgaggtaataattctaagaagaccaagaaaattgttgctcgcataaatacttcagaaacactgtcacctattgtcataggtgggccaaaaaaaatctaatttgaaaagactttgagtaaaaaagtactaatccctttcaatgaacttacttttacttcgagtaagtcaaagaatgaatgctgtgtttgagcacattctctatttataagctcgtttggaaagaaaaattttgattaagccctaatggattcttagtaatctattggcaggagactgacaaaaaagtgattgcctccttcagtttgtgccattggcatctaactcatgtcaccctaatcccagctctacctattagaaattaacagataagcaaacacagaggaaaatgtaattggtttttaacaaccaggctaaacttaaatatttagataaatatgatccttcctaggattttgcagactccatgctttttctaaaaatactgactgctcaaaacctttttagaatgattgctttggaattataatatcttcaattccaatttttgagccaaacaaggagctaggtctcattattttatatccaagacctacaacatgcttggcttgttgtagacctacaatatgtttggctccacagcatatacttagatgagtgagacacagaccttggtctcaagcatagagtttacaatctggtaggggaaaataagacaaatacatggataactttaatactagacagaacatgattaagtgctctaagggacaacaaatactggttcaaaagttggaggcctcaggaaagaattcataaaaagaggggatattttcagtggtcctttaagggcagttaggatttcaagaagcagaagatggtcagaagcagggtggcattccacgtggcagaaatagcatggatgaagctaagtagttaggaaaagatgaggcaatctcagggaacaattaatggccaagaatatatgatatatatttatatacatacagagtggtaaataaagaagcatggcaggaggttaagaccatgttgggcagggtttagaataccaggttgaacttgtacttcattgattgctactagagattcagtgaagattgtgagcaaaagagtggaattaccatataaccaataacctggaagatccaatatttaatatatggtacttgctaggctatttcatagtttcaaaattttaaaaaaattactggattgcagttatgaacttttgaattggaagataactataaatcatcaattttctttgaaactggggcttcatatttgagatgccacaatttataaacatcggttctacgtagacccaatgtctaggaattggagaaataaaaatactagggatgaggaggccagttaaaaggataacagcccagatgatgggtgatcatctaggagtaggaaaagaatggataaagcagaaagctggcattgaagagggacaatctaaaggatgaaggatactagggaaaataaaccattttaccaagaagacatatgttcatcacagcactattcacaatagcaaagaaagggaatcaaccaaagcgcccatcaatggtggattaaagaaactgtggtacatacacaccatggaatactacacagccataaaaaaggaagaaatgatgtcctttgcagcaacattgatgcaggtggaccattatcctaagtgaattaacacaaatgcagaaaaccaaacaccacatgttctcacttagaagtgggagctaagcattgggtacacatggacataaagatggcaacaacagacactaggaactactagacgtgggcgagagggatgggggcaagtgctgagaaactacctagtgggtcctatgctcactatctgagtgacaagaacattcataccctaaacctcagcatcacacaatatacccatgtaacaaacctgcacatttaccccttgaatctaaaataaaagttgaattaaaaaaaaaaaaaagaaaggatggtgtggccgggtgtggtggctcacgcctgtgatcccagcactttgggaggccaatgcgggtggatcacctgaggtcaggagtccaagaccaggctggccaacatggtgaaaccccatctctattaaaaatacacacacacacacacatacacacacacacacacaaaattagctgggtgtggtggtgggtgcctgtaatcccagctactcaggaggctgaggcaggagaattgcttgaacccacgaggcagaggcgatcactctgttgcactccagcctgggtgacaaaagtgaaactctgtctcaaaaaaaaaaaggtatgtgtggaaagaaagatagatagatctatgagaagggatactagcttatgcaattgaggaggctgaaacatcccacagtatgttatccacaagctggagaaccaggaaaactggtagcatggctgagttcaaatttgaaggcctgagaaggtgggcaccacttgtgcaagtcctagagttcaaagactggagaatctggatatctcatgttcaagggcaagagaagtgtcccagctccagaagagaaagagcaaatttgtcttgcctctgccttttcgttctacacgggccctcagctgattggatggtgcctgcccacattggtaagggcagatcttccttactcaaccccctgattaaaatgtcagtctcttccagcaacaccctcacaggcatacccagaaataaagctttaccaactatccgggtaccctttaatacagtcaagttgacacctaaatttgaccatcacatgggacttgggtgacagtgaaagataactttggtactttgaaccctgatgactggggagataacttggccattaactgaaaaaaaggaattcagaagatggtatctggagcgagaagagtggaaaaaatctgagttggaaaccctgctgggatcaaagctccaatgggacacttaagtagaactggctagaaccagtgcaacagggtaagactagatggatgagataacttagatttatatatcaccctttccaacaaaagatttgaggcaaccatggttgcaaaaatagtcaatgatggattaaatcataagacaggaatctccacattaatgttgcaaaaagaaatatatattacaatgaatatactaaatataaatatatattacacaaaatgagggagtagagttcccacataaggaagagaaaatgcctttgctctgagaatcgtctactagacagtgttaggtactttgagacacactgtctcatttaatttaacaaaaaacaaatgatgcaggaagataaaggacaatgaggtttatggaagaagacatcgtgtttggtaattggatcacaatctttatttgaaagttatttcaaaatgtttttctttgaggggagtacaggattaaaagccaaattgtaagtaattaagaagtggaaaggttagtgaagcaggaggaacatcatttctaaaggttttaaaggttacgattatagattggtgcaaaagtaattgtggtttttcccattgacagtaatggcaaactgcaattacctttgcactgttgatgaaaaaagtcaaactccataaaatatttttagagatttattctgagccaaatatgagtgaccatggcccgtgacacagccttcaggaggtcctgagaacatgtgcccaaggtggtcggggagcagcttggctttacatattttaaggaggcatgagacatcaatcaaatacatttaagaaatatactggtttggttcagaaaggcgggacaattcaaagtaggggcttctgggctataggtaaatttaaacattttctggttgacaattggttgagtttatctgaagacctgggacccacagaaaggaactgttcaggttaagataaaggactgtggagacccagttttattgtgcagaggaagctctcagcaggactttagagagacagtaggttgtaaaattttgtttcttatcggaactaaatgggtgcctggctcttagctgattatctcctagatctggaaaggaagtgagaggtgacaacgtgttagcagccctcgctcactctcagctcctcctcggcctcggcgtccgctcaggccatgcttgaagagcccttcagcctgccgctgcactgtgggagcccctctttgggctggtcgaggccagagccggctctctcagcttgcagggaggtgtggggggagaggcgcaggcaggaaccagggctgtgtgcagtgctcgcaggccagcacgcgttccgtgtgggtgcgggcttggcaggccccgcgctcaaagtggccggccagcaccgctggccccaggcagtgaggagcttagcactcaggccagcagctgcagagggtgcgccgggtcccccagcactaccagcccacctgcgccatgcttggattctcaccgggcctcagccacctccccacggggcagggctcaggacctgcagctcaccatgcccgagccacccccaccatgggctccctcacagcctgagcctccctgatgggcaccgccccctgctccacggcgcctggtcccatcgaccgcacaagagctgaggtgtgcatgtgcgcagcacgggactggagggcagctctgcccacagccccagcacaggatccactaggcaaagccaactggactctagagtcgggtggggtcttggagaacttttatgtctagctggaagattgtatatgcaccaatcagcactctgtgtctaggtcggggtttgtggatgcaccaatcagcactctgtatctagctaatctggtggggacttggagaacttttacgtctagctagaggattgtaaatgcaccaatcagcactctgtgtctagctcaaggtttgtaaacacaccaatcagtgctctgtgtgtagctaaaggtttgtaaacgcaccaatcagtgctctgtgtctagctaatccagtggggacttggagaacttttatgtctagctagacgattgtagatgcatcaatcagcactctgtctctagctaaaggtttgtaaacataccaatcagtgctctgtgtctagctaatctagtggggacttggagaacttttatgtctagctagaggattgtaaatgcatcaatcagcactctctgtctagctaaatgtttgtaaacgcaacaatcagtgctctgtgtctagtaatctggtggggacttggagaacttttatgtctagctggaggattgtaaatgcaccaatcagcactctgtgtctagctcagggattgtaaatgcaccaatcagcaccctgtcaaaatggaccaatcagctttctgtaaaatggaccaatcagctctctgtaaaatggaccaatcagcaggatgtgggtgggggccagataaaggaataaaagcaggctgactgggccagcagcagcaacctgctggggtcccctttcatgttgtagaagctttgttcttttgctctttgcaataaatcttgctgctgctcactctttgggtccacgctgcctttatgagctgtaacactcaccgcgaaggtctgcagcttcactcctgaagccagcaagaccacaaacccaccaggagggacaaataactctggacaggaggaatgaacaactccagatgtgctgcctttaagagctgtaacagtcaccgcaaaggtctgcagctccactcctgaagccagcaagaccatgagcccaccagaaggaagaaactccggacacatctgaacatctaaagaaacaaactccggacacatgacacaccatctttaagaactgtaagactcaccgcaagtattcgcagcttcattcttgaagttggcgagaccaagaacccaccaattccggacacagaaggaaggaaaacaaaggggaaagcagattctctacagaatgtggatttttcccataagagactttgcaggacaatttcaaggtagggcaaggaaagatatttttgggtaaaatatttttattttcttccttattatgccagagtcagattggaaagtaagtcatgatatacacggttaaataaaacccatctgatgtgcatttatggtttggagaacatgactccccaaaccccttagataggaatttgagcaagataaaaaaatcagagcttagtcctcagaaccaacctaatgcatgatctcccaacttgatctctatcttcccacaaaagattgacttggaatgacttattattcctaaaatcaatctattcttaaaggcttatttgtctctgtagggtagttgttaagagttaaagaaagaagagagaaacacaaaaagtggctcaacaatcaaggataggtttattttagagaataaacctgagaggggcttctggccaattttggtcaggagcactctctcttacagactaagagtatttaagggtttagggtgagagagcttatcacaggcttggaatatttctgcttggaggagaagtttattacagggttggaatgtctctggttggaggggaggggttatcttggggctgacatcgctccggtcagagggaaggttatcttggggctgacatcgctcggtcagagggaaggttatcttggggctggcatgtgtctggtgggagaggggtttatcttagagttagaatgtttctggtcggaggtgtcatttgtggtttgtggtcatgctgacagccattaggctgatgccctctgggttggatttaggtggtttttgatcaaggggcactttaaaatggcagtgcttctgctctgtcaatagtaggatatgccaacccaaaatatggcactttggcataaagattattttcgagtcaaaggcacttaaaaaaaaaaaatgcaaaaagagcactgtggctttcctttttccttcctgaaagcaggagataaaacttccgtatgaaaggtgccctccctgtataaggaggaagggagatgttctcaacaccagagacatggagtcaaagctgagctgtatctgcacaaacttaccgattttcattttcactttgttacaacaacctttatcttcttagtcacttctgcattaactgcactaacccaaatctgtttgttttctcacattttcacaatttactactctttttagccttccctagaaaaatggagactcaaaagcacttagggtccaactgttaatttgggtctccatttttctagggaaggctccaatgtaaatgtaaaaattactaaataaaatttgtatgctttcctcctgttatgttttatgtctctattttacgtcagtggagactaagctctgattttttttttaatcttgctcaaattcctatctaaggggcctagggattcatgccctacaatccataaattctcatcagatgggttttatttaaccctatatattgtgacttactttccaatctgacactggcataacgagacaagaaacaaaatcaaaatattttaccgcaaaacattttttttagtttttgacatatcttgaaacggctctgcaaagctgtcctttgttgggggaaaatctgcatctacatagaatttctattaacatagctagatcattttcttccaggtcctcccaatcctaaagagattacgtaagaatctagcaccttttaaagatctgaataggaaacatttgtcatccattgtctctaagggcagccactataagacttcaaaagaaccttggtctccacaatcttttattttaacctcaacatttcctttctatgggtcccaggtcttcaactgtcaaccagaaaatgtttaaatttacctacagccttggaagcccctgctttgagttgtcccacctttctgaaccaaaccaatgtagttcttaaatttatttgattgatgtctcatgcctccctaaaatacataaaaccaagctgcgccccaaccaccttggacacatgttctcaggacctcctgagggctctgtcacgggccatggtcactcacatttggctcagaataaatctcttcaaatattttagagtttgactcttttcctcatcagtttaattcttaggcccagccaagaccccaagaggggagaggaaatattttcactttccctacaccagtgttaagaagcccaagaacgcaattcagagggcttcccaaatcattttgaagaatggtaacatctctagaatatcaattagatcgtaggggagtacataagtcatgtgtacacctttaggtgtttgtgaaaaccaaggcatataaaatatcacattatttggcctcagtacattcccatactgacaagcactgtaccatttttcccccgctctaagcaagggcttcctggggggaagagtctgtgattgggtgttcagaagcagagagtgctctcccaaagctaaacgatgccgccaactactgtgaaacttaacttcccctctcccggaattctcatggaagacaaggtctgatcaaccgagggcttaagaagtatcaaattggaactcatggaatcactggcggagctgatttacatatgagaattcctaagcctcacagcatagaaattttcatgcagatggtcctgaaaaagttgttttaattggctaccaaaggtttaccttgcaaacaccaagttcttaaagattacaaaatctaataaagccgaagtgtgaattaaacttaaccgcaagaggagtcacctgcggtcacctcgtttcgcccacaacaaagatgtctgcgcatcgcttaccgtggagccgttccagtgcgtgggccacgcgtccgcccttttccgcgtcacatgaccacgaacactcttccgctacggctcccagaaggggccagcccgcgcctttcgcgcttctgccgtggccctctgcgggccgctccgccggtgctgtccctgggcgcctccgtgctctcagccaaccgcctctgagagcgcccactcgagcgccccgggagccagagggcgggggtcctcgccgggaccctcctgtgggcccaggggtgagtgctgacgtcttcccgacccgcgacctgccgcccgagctggctgccaggcctatcgccgccgccgagaccctccggccaacagggacccgcggtggccccggcccccccggtagtgtctccctgacccgagtcccgtccccgggcctcttgccttcaaccctggtctttcctcctccccgggaccttgagtccccgaggagagcgagggagaggagcgccttctgcaggtgtttttgggcgaacctcttcaccttgtgtggttcggcgtctccttttgtgtattaacccggacttttccgactggaaaataggggtttgggaagcagcgggagtcccgtgagcgtgaacgccgggctttgcaggtcttcactcatccttccctgccaaggccctgacaccttacaggctgaccttaaacctgccttgtttaaaaggaggtttttgtgttgttttgtggcaagtacattttggaaaagaagggccttgttggaagcccaggttgtggcatcgcgggtggctgcgggccaccctgtccgtctgtgagcatccctgctcgcagatgtggctgcaggcagttgctctcgggtttccttccaggagctgggaagccggaggaaagctgcggttcctgttccgccgagcttctgaccttcctctgcaggacgtgtgctactattactatcgtaaaagaacacccctgtctacctcccacaaagttagaagcaaagggcattctcgagggaagagcaccctttcaaaagtgacatgttttcattggagaacattaaaggggaaaaaaaaaaaaaaggtttctggcccttctgcccaaatatagaaccatttgtattcaggcctctcatccaccgagagacttaagatgatcacaaatgttttctctccctgcgtgaaaaacattttttctgcctcaattccgttggctaatgagagcccaaaagaaaaacccttaggaaaattaggacgatttagttatacttagtagtcttttcccatgcaattaaattgcttgggggaccttctatcttttggtttcagaggcttgtatattggttttgccattttttccaaaaggaaattgtgttctctcccttcctgtctgatagagctgcctcctttcagaattgcaaagtttagtcttcgctctcctctcttctggtattgaaacttttctgtgggttcataaccttattttaaagttcattaatatatagttttaaaagtttgcagtgactttttaaatatagtttctttgaaaaagaactgaaacagggtgtgcagagtggcccatctgtgtgaactaggtccacgcagtaggtaataaacaactggagggttttttttggtttgtttttgtttgtttgtatgtttgtttttgaaaagtacataaacatttgcaaccacagtcagtttgactcaagttgtttcggtgacttccgaggctttctgggttccagtgttctaatacagaaaatgagaaagttgggctggaatcattgtgtcccaaaattggtacactttccgctagtggcatgtgacttgactctaggcggtacgtggatgaggatttttttgtaataggatgtttttgcaatctgtatttatatatgtacagccatggtttaaggtagtgatacaaaattttcttttacaatacttttttgattttaaaaagtcgagttaaaaaaattaactgtagcaaaaagttaatgtactctgtgaatatgggaaaaaaaaaacccatgaagttggcaagttagttactggtgtttgggaaccactgggcttagaaagtagaaatctgaaatcatctgtgattctaagagagattttgcctcgtttgttatgtaacagaatcacgtactggttgcctactggattctaaggtacaaaacttctggaattaacatatcaacaccaaatgagacgtttatttattgccaaaagatattatcagaaatgccacagtctaacgagggagaaaaaaaatcagattttgattggttttaagcagaaaacccaataattgggataatacagtgttaaatcttagtagaaaagttccagttactttttaaatgtaagtagttcagctacaggagaacttggctttttccagaagttggcatttcagcatccacctttattttctaagtcactagttttttacaaactcagatattctcgtaagaaaagatgttgctatagaatggaatatagtagtgagacctatgagatgtactactagaaagttcgtaagactgaaatgcaatgaatggaatgcagagaaagcacatttcaaggagatactgaggttctagccacttggttctcgtttattattataaaacttcaatttataatggccaaaggctataatctttttgaggtagcttttttcagtgttagttctgaatatgagcttttgctatgcttgagatacacgcaagtattagaagagcatctcatctggaatgatgcacaaaaattgattataaaggttgcctgtgggaacctgggtggttaaggataggattgaaagtgggacacttccttttctctgtatagcttgcgtactttgtaccgagtacatgcattactagttcaaaattttaacatcgtaagtgaatgaaaatttaaacaggccgggcacggtggctcacacctgtagtcccagcactttaggagacgaaggccggaggatttcttgagcctaggagtttaagatcagcctgaacaacataataagaccctgtctcaacaaaaaatacaaaaattagctgggtgtggtggcatatgcctgtagtcccagctattcaggaagctccattgcaatctagcccgggtgacaaaaaaaaaaaaaaaaaaaaaaaaacaattcatttgttcctctttaacatatatgtgtacctatatgcatatatatacgtaagtattagattcatttaaacttacgtatttttcatctgccacatttttctaaatacaaatcagaaacaatgacagagctagtcttttatattgccttaactaatgaatagttgtaggaccccatctgtggaactaagattggtggtaagcttaatttttttctttctttattttcttactggtctcttgatgtcaggttgtgcatctttgtgactgttactatttggagaatttccagtaatgaatccctaatagtggtttcatctagtttctcaattagcccctgtttttcttccccagggacaaaagtggctctcaatccagcacatgcacattgaagcaagttaaaggatttaatatgaagcacagaagcagatagtgccaaatagcaagcagtagttgttacacatttgtgagtaaaaatggtcccttttggcttactttcttagtctttaaatcgtctgcatgccaaatccttaaagatctatgtccccagagattttttgataaagaataaaagatgtgagttagcagtcatagtcaaaccagttgctggggctgagcgtcctgagcaacctctaagagctctcctaggcatctcagtgaggcgggggcttagggtggggctatatctccagcatggagtttaggaaataccttagccatggtaaagtcatgtatactgtctttaactttttatgtctttaatttatatatagtgtctttgctgaaaatttagtgtaatttccatttgaagtttaccctaaattttgaagtttatttttatttaaagaaaccattagacgtcaaatatgtaggctgcctcagttacatttactttttaccctttgtattcccttcatgatttattcatttgggcttagtcttaaaaaaggatttttcccctttggagtataatgattagaggagttttatggcagtattgttttcttcgaatctgacttcacatttgtatatacatttgatacagcttctctgtatcctgtttgcaaaatcataagacagtgactgtgcttacaactgtctttatgatttttgaggtatagaaaaactcttcttaggatagatttaacaattggtttctcaaatcaagccctaagccatgttcaaatccaaaagtcattttacgtagatatttacttttattcatagttttcttatgaaatgaattgttgaaatactgatttttattctttcttttttacagctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaaggtcagtgaaattttattcagttgagctggtattataggtttgagagacaatggctttaaagcttactgccataggctaaccatgctcttttacatttttatcagcttttgtattggcggcaacattctttctactgcattaaaaaaaaaaaacacatgtaaatatgatattaaatacagattaatagtgtaaaactttcagtccctccaaaaatgaatacaaacatgaggatttattattacaaattctaaatttggtattcattgcatctcagtcattaggagaagttttagtttgtatgatgtgattttcagggagttgcatcttcttttttagtaaattcagagttaatgttatgcatctgtcatttaaaggttttgaataacagatgcatttgtcatttaaaggttttattttttcatgcatgacagtaatttttaattttatatttttaaagtccaagcagctttccctcaaattgatgaggaaattttaagtttaaattttattgcaggcatttttttagttacaagcagcatgcatgtttacgcagagagtatgtgtgtatgtgtgtgtacacatttgtgttgtaattctataataatttaaaaaatttgctcctaagcaatatcctcaaggtacaatttcagctgataattaagaaggcattttgttgaggaagacattttctttcatcttttatttttgctttgtatgtgttcagtacttgcaaatgagaagtttcctttcgctctttctataaggtattgtcttctaacttcactgcgtagaggagactgacattttaacagtcagccctgtctttaaatttttctcccacagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgaacacccatataaccaccaccacagtccaaatagagaccatttttgttactctgcaaggttcctttgtgcctctttctcactcagtccctacccctcaactctaggcaaccatgatctcctttctatagccagagaatagatttgtctttcctagagtttcatgtaaatggaatcatagagtatatactcttatctgtcttcttttgttcagtgtaatgtttttgagattcttctgttgttgcatatatcagttgttcattcagttttattgctgggtaatatttcagtttggatacaccataatttgtttttccttcatcttcattcgttgattgctttttgtttgaagctgttaggattaaagccactgtgaatattcaggttcaagtctttgtgaggacatatggtttcatatctttaggagtgaaattgctggattatatacaagttattttcaactttgaaaaactgctaaactgttttccaaattcttgtactatgttgcattccatcagtgatgaataagttacagttgctccacatccttgccaacattttgtattgtcagtctttttaattttagctgtttgagtgggcgtgtagtgccatcttgcgatgttaattctatttccctgattattaataattttgaacatctgctcatgtgctttttgtccatttatatatatttgttgtgaagtatctattcaaatgttgtgtcagtttaaaaaattggctgttgtaagagttttatatattctagatatcagttttttggttatatattgtacattgcataatttcttatttctgtatgacagtgataaatattagtgaaatgtcaatacgctggaagcatattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggcctggaagcatattttgaaagaaactaatgcttattgggtggtataattcaaaagcagaagaaggtaaatacattttaacaaaaatcactgtctttttaaaaaacctcccgcttttctcttctttgtctcttttcttgaaaactcctaggaaataatgaagatgtttcattttcaagaccagcagatcttgaccttattcagtcaactccctttaaacccctggcactgaaaacaccacctcgtgtacttacactgagtgaaagaccactagattttctggatttagaaagacctcctacaacccctcaaaatgaagaagtaagtagaactttagtatcaccggaatttgaaataatgtagacaaaggtaaaagagaagagcgaagaggctttatcatatctttagcaatatgtcatgaaagctttccatatggaacattactaataattctaatttacaaatgtgccaaataagttattatgctatttttaaaatttgaatgttatgttttaggaaaaatgtaagttttgtggtaagtattattaagttcctgtggtttgaagaaagagcctttatgggtaggtgttacttgttaaataataagaaaatgttgggaagtttagcaataagaagtaaatgtatcactttgttataaaatcagtctagcaaacagggcaaagaaaaccctttttcgcttgacactacccattctcgctacttgattaaaagtttctactgagctactctactgcatcacgttaatgtgccagttgacctaaatgtagcagtgtagactaacaaggtgttagtaacagagttcgaatcctgcctttgtcattgacttacagctaacctttgaagcttctttgccgtgatgattgctggagttacatctttttcatatagcttttgaacttctaacatgttgtcatgaagctagtatgagacaatgtgcaaacgtatgtttttattaataatggtactgcttgtgtctggtttcattttgcatgtaatactttccaaagagggtaaagcacccatactgtctagggcaatgcaattttctaggattaggttcttagattgtaagtttctgctgacataattgaggtaatatgctcacagttagtttggatattctaggtatttggtgaaaagcactaaatctgagcctttacatgacagaaaggcactaacatacttgcagaattgtattatttaacaaacattttttaacttttatctctgagatactatatgcagtataggaattaatgagacatagttcctgcattcaaaaagtttgctgtctgtctggtttcagcaggacaatgatatgagtgagggaaagacatcaacgcatgcagaagatataaaattctttaatagcagaaaataatgaaagttaccaagatggttacataaaacaaaagtatccagtgtgctcccagtttaaggcccagctttctaactccccaaagttccttgggaattatacctgtgaaaataattgtcttacagtgacgattttgccaggaaagaaatgctccttattgtattcttcgggtttttctgttggtctttctgcttctcctaattgaaagcaacccaagcagttccctgattgattattttaagagtgagtgaagaaagtttgccaggatttccctcagtagacccaggctttaagactctacggggttcattcctgcattaattgtgatatttagtcaaatgtgatagatgttcagagtgtataacactggggtaaaaaagtttgtgtgagaattagaactaattttgaagacctactttgccatttactaaccacataactttgggcaagttatttaacagttctagggcgtatctctgaaataaagataagaataatgccaagtgcatgagattgttatgagaattaaatgtaatcatgcatgttctaattcgtgttaaaagctcaatatatataaatgttattgttaggagagacttaaaatcctgtggcaggagccagatcctgaaatgaaagacgagtttctgagattaataccagctgcctattgaaagcaaagatgatggtttggacttcaagtttatacaagcttatagaagggtccagtagccttcaagaagcactcaactgcagtgagcaagggaggaaggggtaagggagccagggttctagtagcttctagaaattgactgaaatagagaagcagtaagggcctgagtactgataacattgatgattcattcaggtgttaactcagaatcgataaagtgagatccccagaacatttgctctgtatcattctgcagtggatgctagaatgaggtagagcaatagtgctctacctcagcactgttggcattttggactggaaaattccttgttgtggtgagagccacctttttgcactgtagaatgtttgcaacatttgtgatctctatctacaagatgccattaccgtcttccaagtcatgatatccaaaaatgtctgtaatagcaaaaaggtggaagcaagtaaaatatccatcagctgatgaatggataagcaaaacatcatctagccatatagtaactcttattcagccataaaaaaatgaggtactggctgggtgcggtggctcatgcctgcaatcccagcactttgggaggctgaggtgggcagatcacttgaggtcaggagttcaagaccagcctggccaacatggtgagaccctgtctctactgaaaatacaaaaattagctgggcatggtggtgtggacgcctgtaatcccagctactctggagggggaggcaggagaatcacttgaaccccggggtggaggtagcagtgaaccgagattgtgccactgtactccggtctgggcaacagagccagactctgtctctcaaaaaaaaaaaaaaaaaaggtactgatacatgccacaacatggatgaaccttgaaaacatgtaaagtttaagaagccagacaacaaaggccatatattgcatttttctacttacatgaaatatccagagtggccaaatgaatgaagacaggatacagagcagtggttgtcagggggttagaggagaggggacttgagagtgactgcttaatcagtatggggtttccttttgggctgatgaaaatattccggaattagatagtggtaatgattacacaacgttgtgagtgtactaaatgccgctgaattgtacacttcaacatggttaaaattgtgtatgttatgtgtgttttaaaataaaaaagaaaatacctccagacattgccaaatgttctctacagggcaagatcaccccctactgaaaaccactgacctatctcaagaaaggagaaggcttatgaggaagcctataaaattgttgtctgaaagcctgattgatgcaagggataaatttgtagaaagcagttgtacttgagttcttaaactggcttaaagaatccaggtgagcccttgaggagggcttaaaacataacataaataatcccttagctcaaagacagtttaaaaatgtgaggcttggctggaagagaggaagttgacaaacactttcaatatgcctaatctccaccaatatttggaaatcagctctaagataagaccattgcttggtgattctgtctgctgggaactaacaaagcaactgttcaataaaccatgtgatctgggcatgaaatacaaaatgcccaagtcatgacagttttcagtgttcctacagtagactaggcagtgtgaatgaggagaaagaagctgtaacactgacattaccagctcttctcaaaaaggaatccgaactggagccagtggggaaggatcttccagagaacaagaaagaagaactgtaaagaaagagttggaaaatgctgcctgtaagaagatttgacacaaccttgaacagtgtgactaagtcaaagatgtggactctgccgttaaatcctatcaatcaagccgtgatatgctttgaaaaaatcagctacaataaaccctaagagctttgtgagaaggccattgaagttggaagaaaaaacagactggtctaaagatagagagtaaaagcttttgcccaagttggcatctcttacttcaaagaggagaaatacgagaatactattcatttctataataaatctttggaagagcactgaaccccagatatacacaagaatcgtcaatagttaggaattaatctggaaagagcaaaatcagttggcatatataaaatctgacctgattttggaggagaagagtaaaggcattgagtggtttcagaaatggaactatctccaagccatgccagctttatacagaagccatcaaatggcatcctccacaggatgccaaattctacagcggttatatccaaagtgtacagccagagctggaggagtagaagaaatatctagctagatccacccttaacacagattatacttagaaagcagcagccttagaatctgaaggatgacacaaaagccatgaatgtctagcagaaggccctagacctgtaattctaccgtaaagaagtagcagatggttattggtgctcagttcaattgatatgacaacgctaaggatgtgaagcaaaaaaccatagctatatgacatatcctaaaacaaatgcagaagggctcccagggactcagtgaatatttaaaagggtcctgtggaagcttagaaaatcaagaacttcatgaatatgggtctgatcacactttggtgatggtttcttgagctctttttccttcctcatcacttctggaaagaggagctgggactgcaatgagcagaatggagcaaaagtctggagagaagaggaaaagctgaattgtatatatgtttacacattcatgcatggaaaattcagagatggacacttgnnnnnnnnnnnnnnnnnnnncgttctttgtacagctacagttttatggccctcttagcacaagacatggtctcgtcactcctgacaaattgggctatgtgtccttcccaaaacccgcagtcactggcttaactgttctccccatgattcgtgattttaaattttggacaatgaacatgttggggagggaagatatttatcccaactgttcagtctacattgataatttgtacctttcccccttctgcataaaagtcccacagaaaatgggggtgagtatagaggaaaaacacgaaggctctgagtagattcctgaagaagaggtgggctttgaacagattgagagaatcagccatcaaaaaacctagaggacatttacttgcccaggaatttatgaacaatcaaatttaacttggggtgtaagcatattaaaggagaattgtatgcaggcatgcaaagtgtctagtgctacatgttatataactatgtagcactagacactgtgacccaacttccaggaagctgcttgaacttaggaaactatttctcagcctccgggatgaataaaactaagtgcataatcactgaaggatgattctgaaagacattttaaaattctgcattgaggccaggcacagtggctcacatttgtaatcccagcactttgggaagccgaagtgggtggatctcttgaggtcaagagatcaccaagcctggccaacatggtgaaaccccatctctaccaaaaaatacaaaaattagctggtcatggtgtgtacctgtaatctcagctactcaggaggctaaggcatgaaaatctcttgaacccgggaggcagagattgcataagccaagattgtgccactgtactccatcctgggcaacacaatgagaccctatctggaaaaaaaaaaaaatctcagattgaaacaaaacaaacatccaggccgggcatggtggctcacacctgtaatcccagtactttgggaggccaaggtgggtggattacttgaggttaggagttcaagaccagcctggccaacatggtgaaaccctatctctactaaaaataacaaaaattatctgggcgagatggcatgcacctgtaatcccagctactcgggagggtgaggcatgagaattgcttgaacccaggaggtgtaggttgcagtgagctgaaatagcaccattgcactccagcctgggggaacagagtgacactgtctcaaaaaaaaaaaaaagaaaagaaaaacatccacctgggattacaggtgtgagccaccgtgcccaaccaaaaacatcaataaatattgattgatattttgaaaatcttaattttcaagtccttaattcacacactatttgtttttttactataaagtttaattttttaaaaaccataatgtcggccgggcgcagtggctcacgcctgtaatcccagcactttgggaggctgaggcagccaaatcatgagattaggagttcgagaccagcctggccaacatggtgaaacaccgtctccactgaaaatacaaaaatgagcaaggtgtggtggcacacacctgtaatcccagctactcaggatgccgaggcaggagaattgcttgaacccgggaggcagagtttgcagtgagtcaagccgagattgtgccactgcattgcagcctgggcgacagaacaagactctgtctcaaaaaaaaacaaaaaaaaaaaccataatgttgccatggctattttagtggggggttttttgtttgttttgttttttttagtatttttgttgggctcagtggctcacacctgtaatcccaacactttgggaggccaaggtgggcagaacacttgagctcaggagttcgagaccagcctggggaacatggcaaaacccccatctctacaaaatacaaaaattagccaggtgcggtggtgtgtgcctatagtcccagctacttcagaggctaaaatggaaggatcacttgagcccaggaggctgaggctgcaacgagccatgagcatgccactgcactccagcctgggtgacagagcaagatcctatctcaaaaaaaaaaaaaaaggtattttcaaataagcagaaaagttaatgattatcactgttctagttatccatttctgtgtaacaaatcatcttaaacttagtggcttaaaacaaacaagcctatgttttgctcaagcattctgtgggttaggtatttgcagttgccgtgaagggaaaagcttgtttctgttcttcaatgtctggggcctaagctaggaagtctcaaaggcaaaggataactcaacagctggatctgcagttatctgaaggtttgctcactcacatgtcacttggtactagctgttgtctgggacctccattagggttgttggcaggtgcacttacacatggcttcactgtgtggctacttggccttccttgtgtcatggtgccattcttccaaatatgagcaacctggggaaagaaaggcagaagctgtactgttatgacctagcctcagaagtcactttgcatcatttctataggagtcaccagccctctgaatttcaggggaaagaaacagatcctgtctcttaatgaagaaggtcaaagatacatttcataagaagagcatgtgggattagagattgcagccattctggaatgccaaaaccattaagctagatacatttttagtctagttttcaaatattcaaccaaatcttaatttgttacaaccgtagaagccaggaaggtttatttataatacagatgctctccatttcctatatgtgcctgtaaacacttttataaattgttcttataaataagtatataccataaggttaaacaaataataattgtaccaagtaaaattgatacttaaaaagaaactagagtagcgttcttaaagtaaatagacattcctgtttatctgcattatagtaagtagggtgtgtgtgtgtgtgtgtcttgttttgtttttaaagcaagtctgtcagtaatacactgcctggcagcaattcttggttgccttttcttagttcgttgtaagttttttgagtagccttgtattgaggttcttttgatgctaagcagctactagcctactaagaatatttctattttcttccctctctttgtgccttaacagatccgagcagttggcagactaaaaagagagcggtctatgagtgaaaatgctgttcgccaaaatggacagctggtcagaaatgattctctgtgagtagaagcactagcattttatctcgtttgtaagttttctcaggatattttctgtacccatgtttttctaaataattacttcatgtagtttttaaaatttgttttacatcaattttatatttttgtaatactttttgtaatcttaaaatctggccattttgttggtcctgagaatttttcagtcaccttatcctttcctgtgtagtatgatttgctaattaagttgtcataagatggtgaactggtcctttccagctttgcttctaatgagctatgttaaacagtgtagcaagacaaatagaatttttttctttccaaaagtattttttagctttctcccttacgattcattgaattttttggtccttttcattttcagaacatacaagtatgttgtttaaaagactatttgtttaaacctttctttttcatttggttgtattatcaaattctgatcttaaagctaccacaagattattaatgtcagtgcttttttacttttttattaaaattaatggatttttacaaacaaaatgttcttcgaaaactggtcagaattttaatcagaaagtcattgtcagtagtggctttttaaatataaattaatatttcttcctcaatgttttggccaattttcgtaaactcatgaaccacatgtgatggcaagtatcatgtaagcgtctgtggaaactgaaagaatcaggagatgatacatctcttctgagagctagcaaatctagatagaagcaaagcgtttaattttatttacaaaataactagaggacaatacagtgatttatattacagcatattaatctctagtttggacctctctaaagagtataggggtacagaaggggttttgttggggttagggtcattgatattaaaggtagagagaggtttttttttttcaaatccttgctttgaaagaacaaggaagttctaatttctatataaattatttgcttgccttactgaaattccattctcttgtgttaggtgaaaggagaactaaaactgctctgatttcttatagaatattgaaatatctcctaaggtagttaaaattattctgaaaggctgtgtaggaagagagcaggttaaaatgaatatatatctccttcagggaatgcttatgcaagattcaaccattagtaatataaaattttttgattgtgttttccctaaaggtatctggttagcagtgatgtcagcaggcccatgaaatccattttttctagactatttccaaatgtattacacaaacggtaaagaggctgtatcatttatggctaaggtggcttcttgatctgctttagagtgattaaacatacactcaagagctttaattattttctttttgtaacattatcctaaggcaacaaagatttctagtaagcttttccacttcataaagatgtggcttactatttaggttcttagctactttgacattttatattaataaaaacaagattattgtaatatagcaccactcttattttttctcccgaagtatatattatttatagctgcattcagctgaagagaaaggaaacccctttattatgtacgaaaaccagtccagtgaagtataatttagagtagatgatatagatgtttttgtatttactcaataacataagttcctcataacagaaaagatttacagtgttaactaatacttgattttctttttttttctttaagttgctttaatgacattttctaaatttttagtaaaactgaaaatctcatttttgatagtaaaagtaatgaatctttatacattttcacagtgaaacacttaacattgcttaaccatatttttcattatggttgtaaagtatattaccatgttatatatgtattttgttaataatgtaactttgccctttcttttcctactgttgttaattttataatttacaatttatctttaagaatctacatcttactaactttagaattttgtataatgaacatattattcagtgttgttaacgtagtgaggaaaaaacaattgatataatacctctattaaaataattattaaactcttactatctttacctactttagtgttttctttgtaacatgaaattgttgtgcgtcatagtgcatgaaactttgcctgtctccactttattttattccatggctttaagaataaaagtgcgaacgggtatgagagcaggagcactagcctttgttttcttaattacttcgaagaggcaataagattgtggtcagctattagcgcaaaagtgaattctaaacagtaaaatcagatctagctttttctttgtgttataaaagctgaatatgtaaaagaagcataattattatttaaggtggcacagatcagattctgccccaagaaataaaatttcaaggttccaggcaccgatttctgcaccggagtacacgtaagattttatctgctctgcttttgacaagtagttgttttgattttgaaggattatgttaatactaatctattcaccaggtaattgacatatgctatcctaattatcttcctgtttggctttttagtacctctgtttcaggatttctcaaactgtcattatatgctttattaaggaaaaaaaaaaactagaccatctaaggaagttgtatatgattttgcatgtgttggtgaaaggaacatgaaatataatatgcacataaggaccaagcatccttttttgtttattttgctttggttggtataatagttctcaacagattcaacgtcacctggtgcagtgatcccaatttttttttttttaatttcagcgcactgtacttttcttcttctatcttgtttctgaaggagaatggagcataagtgtggtttgtcatttattttataatcccatagatgaaaacgatgcttggaagcacttttttgctattattaaacccactctttccatgtgacaaaataaggtatgagaatgactcactcatggagcacaacgttttggtatataatacaggtattcaatagctaatacacttcttaagcaacagaagaaactgcaccgaaagccaacagttttcctcttattctggttctattattatgcttccaggaactattcagttgccatagatagtggcaatatattaaaatttcctctgtatttacaattccaagagaaattaatatatttgtgttttagtgaaaattttttctctttattgttttaccctattttttggaagagtgatacctcaccgaagaggttaaattcacaggttgggaaacattattcctatgaaaactcaaagaggtacttgattttgaacttacttttaataatgatatagttatgccaagtaaatttttatttaaattttaattctgacaattggctggtgtttttttggttgttttgtttttttcttttgagacggagtctcactgtgacttccaggctggagtgcaatggcgtgatctcagttcactgcaacctccacctcccgggttcaagcgattctcctgccccagtctcccaagtagttgagactgcaggcacatgccaccatgcccggctaacttttgtatttttagtagagacagggtttcatcatattggccaggctggtcttgaactcctgacctcaagtgctctgcccaccttggcctcccaaagtgctgggattataggcatgagccactgtgcccagccctggtgttgtttatgtaactcttatgtgataagatttcatgtaagcatgaggtagagctattactaatgaagcatggtaaacatcagtgctttcttcaaaattttctaatcttttcttttaaaaaggtaatgttgagactttgctattttataatatcactggaatcagtttatcaaattgcatttttattaaattactaatatatatataatgccatttacttaatcttctcagtgcctttgcagtatgtttacttttttattttccacaatagttcacttgtcaaaactacagaaacaggaagtcattaaaccttggttgggtccatgagtggacggagatgaaagcgctgtttccctccacagttgatagctgtggagtacattttagctcctgtcaaactgattgctaaaatggagcttattcttttttgtttttacatttatttgtaaaaaataccaacaagactgcttaaagttttaaaaaggaaagacaattgctaaattatttattgcctctaattactaatgtagttttggcattcttaatggtgatttatttcatctgtggatggaattaaatgttaccaaacaaggacatttaatctatacaacactggcaaaagtagtcatcaattaaaaaaaaaaatactcccgatttcgtttttgctgtttatggaggattgccatacacatgaatgaaaagctaatttttttactaatctttgaaatgttaatttcttttgagaaacaactagaacctcaagttatgtttttgatgctggtttttgaggaaataaatatctttactagtattgataaaaacttaatttcatcttttatctttctacataagtatttttcatgttaaattataactgaggatcatgtaaggttttttctcattgtattccaatttcatgtgatcgtaaaatcttagaattgagagagattcttatagattgttttagaatccaaccttctgcattccatcttaggaactctttgnnnnnnnnnnnnnnnnnnnnttttataagatgacctcctcatttcctatatatggacagaaaatacttgtacttttacagtttaaataaacaattcattattgtttgtttctggcaaaaggatttctcttagaggaagtaacccttcttttattttaatttttaatgggccaacatccattaagtttttttcatggatttgagtttagttcattcatactgttgccccaagattataattctaaatattgattattgtagcctttaatatgttagtatatagctggtttatttatcagtacagaatgatacacgaagtgttcaatttaaacccccaaatgcaaaggcaaagtacggatttgtcctttaaaacttgcttgagtgaatttaggcagttaacgctggctgctctatcaagaagagtgtaagatggattgtttgtttatgttgatgtagaactgaccattttttaattctcacaagcagtaagagcttcaggttttcccagtgctgcctaaagagaattctgagtgtaagactaacatatagttttgtttcacagataggatgttttttttatttgtttgtttgtttgtttatttgtttttacccttctggaatgcctggtatgggttttgccaattaccatggatcagtagataatgttggcttatatgtattcccagagattgccagtctctggacggacatttaaggtcactggtcatgagactgcatctgaaaatttgagtttatcttgacaccaaatttgccctaaatcctatagtgaatcaggcttgatagatagttgctttatacgttaagatttggcttagatcttttaagtagtctttgaaaaacatggttttcatattatggtacttctgtctttggatcaccaagccattcaaagttattcataaagctgtggaggagattttgttttttaattttctgggactctgggaataatatcagatgactataactatcctgtcaaaaattatcccacttattttgtagtttccaaacaaatacatgctgttagaaaagattacacagtcaaaataagagattttcttttttcaattgtttaccatctgctttgtttttattctttcagatgtaatacacattggatgacatttagcctgatgttagttttgccttgacgttgagaatgttgagccctcattccactgtcgtagtctgtatgtcagttaaatacctcacaatagataatcatactgtaacgttaaacagctccctgaaaatactgacacagatcttaagagtttaggttagaaccataagaattggttcattcagctttcagaaagcactggcaggggagtcaaatgaaattgtgaatctcagcccacacatgaaagaacgattaagattattgtcactaagaagcccagaaatggttatcagccattgataatttaagaagtgtccttgccttcttttgctgtattcacagatttgggaatatttttatgctttagtcatttaactagagaacatatgcttactataattaaacaatcaaaatgctttgttaccattttctaagactaattcatccttaaatcagtgtcatttattcgtcataaacttcaacttcattggctttatgaagtgtttgaaatggtgtttttatggaatcacttttgattcatgtgtttaaactttgacatctgtatgtgagaattccctgtcctactcttctaatcatccataagtcgacagcagtgttgtttcttagaagttggtttattgaattggaatataaacacgaagtaaagaatgctgcttctccatgggaggggttgaacacattcattgctgtagttctcttccctctctacagttctttcatattcagtttatttattttgatgtttagggttacaaagttataagtgctgccttgtagctagtttttggaaacaattcaaaatatttattctttgactgttttcttgtggggagagtgaagggtgggaaaggggcaagaacactaagaaaattaagataaagactgctcagctgaagttttataaaaatctgacttgagtgtttttctcttcatttgctgtgcttgtgtaaacagtgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcaggtgattggccatccgtgactcttgacagctttattgcatattttttggcctcttgtttagtggactgtggtgtctttcttttctgtttttaccttctagcctctttctaagatgcaatgatttgaaacagcttgctttactttcttttaatttgaaattattgtccaaaattcacatttcacaagattacattagctttccttctgtcagggagagtatacatagaaagtgtagtgatttttttcaaaggcttttctagcctactctaagtacttgattccacttagggatatgccaaggggccccgtcccattggattgagtgttagactgaagtttactagtcctcgttagtcttttgatttaatcatttatgctgctgatatgattggattaataaagcaaatctgaggaggtgatgtcagcgcagctgccaggacacttttttcctttcctctcagctacggatttctaggcttgttttgaaaattccaggtgctatcatctttttgataatactgatatttttcagtgttgataatttatctcacttttgaacatctccaggtaaaatcatcagtagtatacttagacttattcatacaaataatttttttgcagttatctcaagtactttttgtccttgctttattactacataatgttttaaaggaaattcagggagcttttttggcatagtgtgggaaagatagagtcaatttcatttcaactctgaacatttatctagtggcttctggtagtcagggtttgaattttcatgattatttaattgttactttttgcattttgaagaatttcacaataaattaagctatcccttctaataaatccagtttcttaccttaggaacgaatatgacttctgacttgcactggacaaactttttcttgttgagtgcttgtagtcctcacacaggccctgggtatgtcaccatacttcgtaagcacctgtccatgctacttatcattgttgaatccagggcctttctgagccttcccagagttgacctagtgctatgcatttgggcccaaggactgaaagctgcactaagaagagcttaaaaagaaagctcatggcatgagggtgtggggaggggaattatatatacatgtatatgtatagatctgttttgtttgtttttccccaagggtttagactcccttttatgctttttgaagcttcaaagacattcttggactattgggaagctgtaagaagcagcaaggttcagaacaaaaagcatggattcagggagtcagttagaattaacccggatccaccccactacatagctgcatgatggccttgaacaaattgcttagcttcttttggcctcacttttctcatctgttgagaaatagagaggaagggtaataatatctagctttgtgaattcttgtgaggatcttctcccctcccccacctttaattataatatagggataatggcctccaattctttatttagtatggtaggagatctttcaaatgatattgcatataaagtagctggcacttaagagctaatatttacaagggcctgttttctcttccctccttaaaacagatttattgtccatcagctaacttgtttaactttttaattacaataagtccttagtggagaccagattattaggtgcgagtatatcatatcaaatgctattacatttaaaatatctgaatgagagagatatttccaaatcttgtataaaaagtaataatagctagatggcagagtcacagtacattaaaattatatgtcccaaaaagtaaaaaaagaaaaaaaattatttgtcccaattccccctcaccagcatatacacagttcattgcaataatgtggaacttataaaaatatggattttttcctccataatggaaaaaaaattgtgcctcagagtcaaatgtataaaatcaaaaatcgtattagtataaactttgtatttttttaataatgaaaaatatttttggactttcagtgaaattttatttcacttttttacattgtgatgaattgataactctaaaatcccttttctgggaaggaattctcttttctcattcatttcagtaagtttttaaaagttcatgaaggagttatattaataatgcttttctcctagatctgtagcattagttgttaccttggagcttggagggttagattctcatcagtcttattgacgctttcagtattgaaaggattttttaaagttgtattcacttaggatctcagtgttgagcaagattttatcagaattttaagtgccaaatcagtttttatttcctttgtgagaagtatctggcatgacttttcagatataagaaataggaatgtgaaatttggataatgttctacttgcatgattataaaataatactgcttataaaattttaagtgcttctatgttccttgctctgtagatcattttttcttttctattttattactcttggctattatgctaatgcaataccttatctttggtcatatgccatcacattaggtgtagttaatttaaactagaactatttggcagaaaaagaaaaaagctttctgcttgctttatcactatgaagtaatgcagattcacaattccttgacataagaactgtgttcagtttacattttaaaggacgctgtcaaaaggtttgtgtaccatatatttttttcttacaagaatgtagatgatctaaaccaaactcaacgtgaaaaccaagttaaatcctaggtacatgttagaaaagtttatttacacaggtgagtgttacgcatttggagaactgatacactgaaaatttaccaaagcaccaggtgtgtcatttgctcaggtgcagcagaaattaaaatactattatgatttggtccttaactggttagaaaatgccggtctctccctgtatctgttagagctatgtatctcattttacaatgtaaaatattcgcatcttcaaaaagaaacttagttcctgtgtaagaaccttatttaaatattgatagatgagtcatgcttagctctcatttttacgaggggcttgattatttttatgcagtttttccttaacagattgtaccagctttgagtgcatagaataagaaaccaatgtatgaataatttatatttttggcaagtatccctataaatatacagcttggaagacctagaaatccagagttgcagtggatacagcgtttgttatttataatttttctctttaaaaaagtgtataattcctgatccccaattaaactttattttctgtagcagattacatttttatagcaaagaaacacatattctgttacgtcagagtgtatttactcaaaaaatgtcagtacgcaagttaatggcggagcttggtggtagccttggatttctttcccttttgccactctacaaaacatactgttgagaagattttatgtattaaatcatacttatcgtagaaaatggtacttgaatgaagtttctaactttgccacatacctgtctaatttacttttacaatatatgtgtcaattgccagtgtgagaagacaaaatgaaatacgttgtgaaaggtaactgtattattttctggctctgcgttataaaagggaaatctctgtggtggaataggttgaatatgacagacccatttgaacatactgtgtgcattttaaaaagctttaggaagcacacagtgatggcttcatctagttaaccattttcatgttagtgcaatttaagattgtagttaaataacaggtttcctaatgccacagagtaaatatgttagtaggatgagatgagttaaagacctgtcttaagcatatgtgatttctccatgttttttagccagtaaaataaaagtcaaacatgttcccccgaaaagtctctgaatcccttatcatctaggctccagaaatttctttaagcactggtagtacctttaagacatgtagaagttaaacattagaattttcttacatgaattgaattatcagaaaataatttgtattgtcaaaattccacagctgtgccaacttacagaaaaaattagtgcatttggtattaaacatttaccattatataattattgtcttgatacttaaattcaggcaaaaccagatcagttacttagagaatgagatatccaaaataggatttaataattcttcaaatctttatatggatccaacactccagtctcttttctctgcttagtaaatattgctgattgttttagggggaattgaccagtgaacacttagaagcttttgttttctgattttaaaagataaaacgtattggaaaggttactgcttatcaaagtagaaagctaactgtcctctagcgccaaagtatatactgagaatgagtggaaatccccaccaagtttcccattgcaccttagtcttcatttccagcagccctgtatgtcactcctggctgtctcaagatcagactcaaattgtggattgcccttcctgtaatgtgctctagcacgtctcctgatctcagcttcagagtggaggcttgcattttcactctggagagctgagagtttgaatgagacacagctgcaacgagacatcaggcactactcaaaattaatgaggtgggagggaaggaagtgtgggaaatggagtttcttgaaatttatgaatacggtttttgagatagagctgttgatatcagatgagcaactatggtcataccggtgcagctaaccaggtcctgatatgcttttaaaggtgctagtgattttttttttccaactggaagaaaggaattacactttttaagcagagttgtcctctgtcttaaatttcataaagtaaagcaccaagaaaattattttatatgttggtgctgttttgtcgtgtaaatatagattccctttgtttctttgatcaatagtaatgttgagtttatgaaaatgataaaatggaggacacatgagacaaggattttttaaagtagttgagagatattatattgtattgaaatatacaatataatcctatttgacatttatttgtcttgtttttgcttttattttattacttctctgtttcctgattctgtcttgtgccttctcccgcaaaaacctgccttagacctgtgttgcgtggtgggtctgctgccgccacttctaatcctcatcatgacaacgtcaggtaaattttgagacttcgtaattaccagggtaaatgcttggcggaatttgtgtgttgcagggcatgttgcatgtcgtagccatgcctgtgtttgtagctgaacttgtttctacagctttcctcgatgagtacatcttgcttctctctaagaacagtgaataatcagtcatgacatttggccaattagtatgagggaaaatgtttaataattatggtatgatgtgaacagctattttatttaagtgtagtgttaatagtttataggtggtttataataatttacatgctaaaacagaaaaaagtcttaaatcttattttatgtacatcattttaatggttgcctgaattgtgcccagcatttccttttaagttgttaattatctggaatgttacttttagtgtgtgaacaaacctgtctttgtttgtaaggcttcatcttaaattgggagaaatcagcattaacaactccacagtttgggaaggtacatatttagaaaggaaatttagttttaagcatttttatcatctgttgatttaaggccttctctcttatttttgccctttttacactttcagacacgcgtaggttgagcgttcctttcttcctgacacgcacagaggctggcagaatggcacatacaaatacatgcagttcttaagtgccaaaatccccatttagttttcctatagtctggaaaaaatcaaaaacttgttggtattcacagatgctattactgtataattttttcagtcagttttatttaagcagaaatatattgtcggtagcagtagatttaaaactggcagcatcgtttctgtgcttagaagttggtgcattcattgaagcaagagaaaagggaagcattagctgctcattaaaattgaattcatggtggaggaattgaaaagcgtgcctgtggtaatcccttaccactctgctgacttgtttctttttacaatcttagttcagttcattgtcgttttcccttatatttttctctaagtttgtgatcttttatctttctgtcagagtattttcagccagtggtctaacttagcattagagttttttagttctaataaatacggtttttgtttaaaacacaatgtaaagtaacatatttttgttttaaattgaagtatataggtaaaatcttttgtcatatccttatatttctttgcaaatcgagatttcagatatctaaaccttagttaattcaggatataaattgtgagtaatcgctttcatttgtacttcattctgtatgttcagtnnnnnnnnnnnnnnnnnnnntttaacaattgcttctgtttgatttttttcctaattattcctctgttatgtggcctcagtaaaagagaagagttttattttgaggatgaagtgaaggaaaagggaatcttctacctttattttttccactaatcatttgtaaacccatagttccagcatctactaacttagaagtttacttctctaactggtataattaccctaactgctccaggttgtttactgtgttctcatgaaataaggagacagttaatgagaaagcaggataatttagccatagaaggaatatttggagatggttgtagattatctagagtcagtacacaccatctattgtttaaggttttttgcatactttattaaagtatttttattacttttaacaatatttaaaacaaaaggattttctgagtagacttgtctttaacatgtctggatgaaaagtataattctgcttcatatccctttttgtgggtatgtactttttgtagtggggacttgctgggataggtattagaatagatgatccatttgccaattctctggactacacaggaataacttttaatttagtttatttatattctgctcatttagaaaatttactatgccattttactaaaataaccatttagggtataaaatacatgtgaggtgaattatgtggttatataagttgtatctcaatgaagctattaattaaactaaattttaaaatgtggaaatccaggcaaagaagaggaatggcgtttgtctttgtttttcagaggtttagtgtcattcacctagaaattagtgccgctttagaagtaactacattggaacaaaaagtacttttttaatatgctttctctggattttgtcttaatggtttttcagtattattttatacacagcattttattcattattgggccaattctggagctaaatgtagtggtaagatgtattcaggagattttataattgtttctgcgggagaacacagtagagcataagtaattggaaataagtaaagaataggccaggcgtggttgctcaggcctgtaatcccagcaatttaggaggctgaggtgggtggatcacctgaggtcaggactttgagaccagcctggccaaaatggtgaaaccccatctctactaaaagtacaaaaattagccgggcatggtggcaggtgcctgtaattccagctacttgggaggctgaggtaggagaatcacttgaaccccagaggtggaggttgcaatgagccgagattgtgccattgcactccagcctgggcaacaaaagtgaaactctgtctcaaaaaaataaaaagacaagaagtaaagaataaaaatggcaagacaagaggcagtgagaagaggtgatgagtctttctttttttagagttagtctactttgtgttccctgctagtgagtctgtgcctatgggcttacatatggacataagtttgtgtaagaattatattttgttctatcctaagtggcagctctcaaaccttttcagccagggaccctttttagcatcgccaatccttctggcttgagaattttctatgtgtttctttagtcaggatttttttcccattctccagtttttagtgccctttttcaatattgtagacagttgtcattttaagcttttttctttcctttattagtacaaattcaggtagtaaaatattttagtaattcatattattaagtaccaattttctgaatactactttgagcattacacaaagcatgatgtggcgtgccatttactctgagttctactttactattcatttgtatttctatctcttatctgcaggtatggcatttcaaatatagatacaaccattgaaggaacgtcagatgacctgactgttgtagatgcagcttcactaagacgacaggtatttagtgtaccaaataagatatatttctcagttatattcatacaatattttaaagtgatagttctcaacattttattattttctctcctgtgggactatcaaactagtaagccatcattgattttctcattttgattaaagatatattaaactaccatttacatgttttgatcaccgtaaaacagtattaccaagatagattaatgtaattctggccagtaacaaagaatctttagcaaaccagtacagccatcagttgcttgtttggcttttgaaatgtggaacaatcactttggaacctttgttactgtgtttaataactccattttggaaaccgctccttgcagcttgcacagcgtccctgcatacgtatttcctgtattctgtaataaatcctttcttagaactgcagttgcacatgcatattttttaatatgtactcccacagcctcgagtatcacacagacatacacacatgtgaagaaggcatagttggttttctcattgcgtctataccaaatagatatagagggaaattggattaaataagatatttttaggtgaagatcagtaggagaacacaagctttagcaggtggttgttcagccctgggattttcacagtaagggctaacagcaaggatggtactgtcagccagcagcatttccagcagctggggaattagccttcaggcctgaagggtttgggtgccatatcccaaggccccctacagtagattattttattggattgtctcagtaactcagaggtggacagagaaggcggttatgccaggttcaagatgaacaactgaggttgagtgacaagttcataggagaggcatagaaaggggaaggagtcccgtattctttctgctgtggtaagcctgccaaaatgcatactgagtcttttctgccagaataacagtaggtaaccgcttcctcacctcactatgtaatcaagttaggaaggaaatacacccttcctaactcagaaatctgaagaagggaaagggaaaggatgtttaagtgaatttaagctgtcatgaatgacatgtttttctatgtgtagttgtgtttattttgctccaaatgaaactttccatgtttgtaataatacttttgttgacaaattattatactacttactttataagaatctgattgccctattcattaaagcctctatattatattttttgtgtgtttgtttttcacttagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaagtatttgtctgttgaaggattttatttcatcatttgtgcaatcagctacattttgtatcatattaccttatgagtcttcccgtctcagagcaagtaatacaattaatgacctggtaggtagcaagaacctgctgtgcttcctttcagaccttcatcctggtggtggtggctgttggttgcattgtaggtggttttctaatttataatatctataaagtggttcaggtttaaataccttgagttgtgtatacttttttttttttgagatggagtctcgctctgttgctgatgctggagtcccgtggcatgatctcagctcactgcaacctccacctcccaggttcaagtgatccttctgcctcagcctccagagtagctgggattacaggcgctggccaccacacccaactaatttttgtatttttagtagatacagggtttcgccatgttggccaggctggtctcgaactcctgacctcaggtggtctgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatactttgggcaggcctaggcgggtggatcacttgagtcaggagttcgagaccagcctggccaatacagtgaaaccccatctctaccaaaaatacaaaaattagccaggtgtggtggcaggcatggtggcaatagctgtaatcccagctactcaggaggctgaggcagaagaatcacttgaacccagaaggcagaggttgcagtaagctgagatcatgccactgtactccagcctgagtgacagagccaaactccgtctcaaaaaaaaactaaaaatttaaaagtaaatctcaaaagaattaaaccaagtgaagccaagtgctagacagttttagctctcaaaacttatatttccccattttcggttcagaaatgggtagaattcagttaggtgcaacattctccacacatctttggtatctttcttccaaggcagggagtttggggaaaggcagttgaggaaattccttggatagagttagatttagcatttccgttcttgcttcttatccctctaaaataatatcaagacaaagattcttctctgtacttagaagttttctgacttttggtaatgatgcaactatattaattctagatttatgtataccagaaggtaatttctgtggttatcctccaaattgaaatcacaaaaatgaagaaaaatgatggataaggttagtatcttttgataaacagacatgaaaaggattccacaaaggtcaaaaaatgaaataaaagcaggaatactgagagagaagtgcggaagccctttttttccctcatgattcttaccaaagaatggacacttggagctttctcccttaatgattgtgcaaggggtagaagatcgacttccctacctcaggcaggcaccagctgtaacaggagactcgtgaatgaagctaagaccccaacagacggtgaatgaaaactctgtttacagtgcaaaaggggacaaccaagaaacctgccttacctgaccttgtcacatatctagaagtagaaaagcttgaatctctctaactccaaagttaggatctctattaaacacctgtgtacttcccctaaaaattgttaattactgttgaaatatattttggagttgagaagaacaaattagttcctggttagtataaccagatatttgagctgagcctttcaacaagcagagaaagaacaagaaaatattccaggtgcagatgatagatggagaaatggatacagtcaggagccaaagtcgtatcatacaactaagtatagcaaatatattgttgcactactgaaagtgcacccttctccccacttctagtaattatggttgaagtatgtgcaggttgtttacactttgaaggataacatcatggaagtagtatattttcaagagagctttcctttttccttccttcctgcatgaatgtgtgtttccagctccttaactatagtgattgcccagcccttatccaaaattctttggaccagaagtattttgaatttcagagtttttcagattttcaagtatttacatatacataatgagatatcttgaggatgggacccaagtctaaacatgaaattcatttatatttcatacataccctctacacataacctaaagataattttatacaatatttcaaattttgtgtatgaaacaaagtttgtgtatgctgaaccatcagaaagcaaaaagcaaagatgtcatagtgatatctcagccacgcatgtggacagtcgggttttttgccatcactatcattcctgactctgagtgtatatgctgccaataaacagtcattttttcttaacactttttcacacataaatacttaacattaaaaaatgacacactattaatacagtgaaaaaactgcgttcaagtaactaagcagcacaggggcatcaccagatactgcaccagctgttagacaacagccacaaccaagaacagccacggcaagtttcctgtccccactggcggtactgttggagtaaagattactggacactatttttttcagtgagaagaaacatgagaagcagttgagaggctaggaagtggatcctgtggagacgaggcattcttctcagtggctttttaaagtatttcttccagagtcatctacctcatgaacaatgtttttgtctgagaaacctctctttgcttttataaactgacgtgatttcttgttctgttttgaatacacactgctctagtccttcaagaagcccatcacgtattttcaccatataatctgtaggcactttttctgcaatgttaatgtcttcactattaggatcacctttgattcagaaccgttcagctatttcaccatgggttgatgaacaactggagacccatcatcgatgttaaaaacttcaacatccacttcttccagcttactgacggactctgaaggtatattttttacatatataaggaggtcagacatcatttttttttctcacttgacatagggattccttccaagtcaccaccttgtttatcatcatcactgaacatagttgcaggccagaggttgtgctggacattcagaactgtgtctttagtcaccgtgttctagttgttggcaacagcatatggcatccttcatgctaaacttgttttggaaaccttctgtgccatgccctgttcactgctgctaacatgctattccaataaagtttttatatttactcattgatgtaaggatactctggtcactggctgaattaatgaagtcacattttggggaaagtacatggcataaatattttggggggtgatgagaaaatttgtaagcaccattgctgacccttgttcactagagtacagtgagctgtcttatttttgttttaattacatgaccattagcagtttgacagttcattgagtaagtatcgagtcttcgctaaaagctgagtactgaagataggattcattaattcattcaactaaatgcaatgtttctgctttgtaccaggcactgtactaagtactctttataccaggagggaataaacatgttcctgtacccctggagcttatagtctaatgggggacagtgaaatttaagaagcaagcacaaaggaaaatgcaatcatcattgtgataaatgctgtaaatgaaagcatggtaaaagagtaaagggaaacctagttttcattagacgtttaggaatagcctctcagaaaaagtggtatttgtgctgaagtcaaggataaagagtgctgccagagataaggcaggtgggggtaggaatggggctggaggtggggaaatgagaggcgttgctaaggacctgaagaggtgagggctgatgaacatggttcctgtgctcctgaatactatagtgatggacgtacaaacacatgtatgttacattatgacaggaatgataatagaggcttgggtaagtgctgacttggtttattggatcatgagcactgggaaggcttcctcaagtaggagatacttaagctaggccttaaggacaagtaagtatttgtaggg

SEQ ID NO: 11755 - DNA, 144158 bp, Human
  misc_feature (1)...(144158): n = A,T,C or G
ttccaaaacaagaatttgtttttattgagatgtgctttagacaagcttgtccaacctgccttattttgttgttgttctattttgttttgttttaggcttttagcagcctgaaaccatgatttttagtttctttctctagtgataagcagaaaagagagatgaggaaggggctttactggcccaaccagaaacagaaactagggacctatgactgaatactctcccttaggcacccctgagtttataactaaaacaaatttaaaattatggatttagggataggaaaagatctgggtgttcaaagtgattcagtttctgcttgatattgaaactttattgtagaatgttgttctaccacttacttgggaaacaagtcttccatacatacagcattgaattaatttgctcagcttttacctagaagtttaaaaataggtaatggccaggtgcagtggctcacgcctgtaatctcagcactttgggaggctgaggcaggctgatcacctgaggtcaggagttcaagaccagcctggccaacatggcttaaccccatctctactaaaaataaaaaataaataaataaataaaaaattagccgggtgtggtggcacactaactactcaggaggctgaggcagaagaatcgcttgaacccaggaggcagaggcagcagtgagccaagatcgcgccattgcactccagcctgggccataagagcaaaaccccgtctcagaaaaaaaaaaaaaaaagttggtaacattgaacattcccggtttccttctctctacctaattctcatagagacaggtcttttaaagaagccaaagttttttaaatgatacatttcaattatttgagccaaatatatcttttatcaaagtaaagacttcttcgagtcaagttttaaaatattttttctattttatattgataaaattaaattttatctcaataaaaatataattcacaagatgaaataaaattcagcattttaacttttttaaagtttactattcagaggtttttagtatattcataatgttgtgcagccataaccactgcaattacatcatcccagaaagaaactcaattctttcctctcccaaaccctgacaactattaatcaattgcctatctatctgtatggatttcctattctggactttttatatacatagaatcataaaatatgtggcttctttcacttggcacaatgttgtcgagattcattcatgctgtagcacatatcagcacttcattccttttcatggctgaataatactccattgtatggatataccatattttccttattcattcacccactgatggacatgcgggttgtgttcaccttctggctgttatgaatatgcttccatgaatattcatgtgcaagtttatgtgtgaacatgtgttttcaattattttgggcatatacccaggagtagaattgctagatcatatagtaactctatgtttaactttttgaggaactgccaaaatatttttcacagaggttgtatcattttacataaaaatacttttatatgtatttgctgtatgtgtacaaatatacaaaaatgtatgtttgtatactagaagtttccttttctagtttcataaagtaaaagaagcatttgagtgaattttaacttggatgttcaagggaaaaaattaaacagaagaaaattccacatagcaaaatgaagcaattatttatacatatataaaaatatattttatatttaaaaatatatattttaaaaatataatatatacacataatttttccatttatcaaaaatatattcatgatatagaaagggtttgaagattttttatttctgaagataaaaactgatatttattcagtttcaccatcactaaggaaagattgttgaagttaccctttagaaaatatttccataacgataaaaaatgaaagtaattattttcaacattataatgcatgctgtgttttaagtgatatatttatatctaacaggaacagactttgacccagaacacagaacctcacttgtcaacaagaaccttctggaagagaagactggcagaatattttttaagtactaagacttgcctgcgatgtggtctctgcacatagtactaatgaggtgctccttcagattgaccaagtccttggccacaggtccctggtgagtatcctcagtgtgattgcctgcttttatttagtaatttctactcaatgtttgttctatggatgtaaaccgtctgaatgcttaatatgtcaaaaagccaaatcattccagaaagctaagggtatgtctgccatttcatgactcatttttattattgaacaccaaccctctcaattttccctgaaatgcatccacaaaatcaccaaatgggaagttgcacaaggaaaggccccagattcttgctcgcttactcactaggtttgaatagcaaaagacatatgcccaaagtttcagggtccctataactagaagagttaggacagactacttcacaagtacagattaataacacccccagccctccacagatgtccacgtcttaatctctggaatctgtgaatatgttatgtcacatggcaagatggcaaggggtaattaaagctacggatagaattatggttcctaatcagctgacattgagatagaggagttgacctgagcttgactatctggatgggcccaatataatgacaagcatccttggaagtgaaggagagaagcaggagagcagtcggagaaggagctttgactacaaaaacagaggccagcgggatgcagcaagagagacgcaactggccactgctggctctgaaggttgagggggaccaggagccaaggaatgtgggcagcctctagaatctggagaaggcaaggaatcagattctccccggggacctccagaaggaatacagctctgccaacaccttggttcttggcagtcagacccatttcagacttctgacctccagaaccataagataatatatatgcattgttttaagcctctgagtgtgtggtaacgtgtgacagcagcaataggaaaacaggaaaccaatatgagattgttcaacgagactcaaaatgacattgggagttaacacagggaaatgttaaacagtgaaaaaatacaaaaagttctgaggataatgaacaagaaattacggggagtgaaagaagtgaaggtggtgggaaggaatatggtccagtcttaactgatttggggtggacgtggaagaaatggaaaggaatcttaattgtggatttttttttaaagaaaaaaaaaaaaggaatgatcttactttttaatatctacagtggcagaaagaacaagtccagtgcagtataaagggactatgaaggagcttcggacctgacccgagctggccccctcggggccattctgtctgcactctttggagcatattgtccaacttttctaagtctgtttgctcttctataaaaggtttaagaaacatgctgtgcctacaatccttgatgagattatatagagaaaagcgacaattgctataaaatgcaacatatcctatttaaaaatgtccagtgataataactcatttaacaagcaagagttgtaaatacacattcaacctgatttaaagcagttgattcccggtgtttaacacctcctttatatttttctctttatttatttggttactacaatgaaaagccaacctggcttgtgttggaattatcatgaaaacagctgaggagagaggaaatttagtgtgggagccattaagtatgggctggacccagttactcgtctcccagatccacagccctgtaaacatctgtagtgtctgtcggcatctcagcaaaagaggaagaagtagagggtggagaacaaaggctcacttaggacatgaggttttagagaggagaaggctctacagagaacaaaagaacaaggatggcagataaatcacagcccagaactgagccccagttctcctaccatcctttggaatggtgtgacccgaagttctaaccacagctgttttaagcgttaaataagatgatggatccagaagctgtttgacaaatataaggtctagaaaatatatgcagatgtttaatgggtgttttgttttgttgttttgagacagaacctcactctgttacccaggctggagcgcagtggcacgatctcggctcactgcaatctctgccttccgggttcaagtgattctcttatctcagcctccggagtagctggggttacaggcatgcaccaccatgcccagctaatttttgtattttagtagagatggggtttcgtcatgctggccaggctggtcttaaactcctgacttcaggtgatccgcccacctcggcctcctaaagttctgggattacaagcctgagccaccgcacttggccttttagtggtcttttaaaattgcatatgtcctctgttaaaatttgtttgtaataatgaagttaccccagttggatttctgcctcacttataaggccctggactacataacttttccctaaatattccatattatttccttttttctccaaaccatcctcccagtccagttaggtttccttccaccttccctccttctagttgcttccactaaatggcattatgggatacactggtctcagcaatgtgcatgtctgaacaaagctgcctccttccttctctcctgcagttttcattctgagaatcatcttctttcactcatctgtccctccaggtctcactttcagagggtcctcacggtccccagcacaatgaggaccacacaaggggttcaacacacacttcttggctgattaaaaagaggaaaggcaatgatggcagccagagagaggaaagcatggatcttgtcactgatgacaagtcggctagtaggagcagcctcatagaaataaaaagtagctttctggaattaattcctttactctttttctttttgtttcacatgaaaagaaactgtttaaattaatctgcgtttttgtttttctgtaggtcacttatactcattctcttttctgtacaatatgtatatggggtaagtacattcactagctctggttgcgttgtgaaaattcactttatagaatgcataatttttgttatactttcaaagaaatcaccctctgggactcaattttcttacctgtaaaatggagaataggactaaataaactctaagatttcttttatattgtatagtcaagactgctttctgaattgcctaggtattggggatttctttattttaatacaaacataaccctttctttaaaagtttttttttggagacaggcaagaggcagctgggccatttcaagattaaatcaagaaatacaagaataatttgaacattttagctcagaagaaaaataagcccagaacattctgtaataagctatctttcttctgcttcctcactgaagaatcccagtcattaaactcaccctcagacgtgtctgggaaatcccattgtggcctgcctgcaactcaggttgatcttgagacaactgacttggtttaaatcactctagtgaacataaccctatctgttcatactctccaccttggattcacccaatgcaatttcagtgaatcaagttattgtaggttttttcaaagcaaatcaaagtgcaaaattaccttctgttctccttttcctacaagttgggagcagaaaacacctgggtcaaagaatgaggagccagtggttcttggctctgccaaagattcatttcttaacttatataagactcagttatctcctgtattgagtagggatgataagacttgcccgactttgttgacatgcatttgagagtatcacctgaaataatgagtggaaacaatactatgatatatacatgtgtattttttctatttctcttacctgatttttaaaagtttatttttgtgttatattctttttcctgttataaaagtctgcagagtcctagattttactttttttaaaatattgcatacaagtaaacataatttctgaatcaaagatttttctatcccaggacttctaccagcttgtggtgtgcagagagtctagagatttcacacagggagtggccatattatcattgggttttaaaggtagcaatacaaatcgatgcgatgtctgtgggaagcgatttggtattacccatccggattttgaatgcacgtacctattgacacaggaatgtgtctttttggaatttgtcatacgtgtttattctgattcatgcatacagataaatatgcccaagagtactaatttcagggtagtgttcagtatagacagaagggagctccctaaatttccttcaacaacaactggttaaacaaagtatggtatgtggtctgatggataggcatatgtattactttggaatgattttgaagactttcaattatgtgaaaacagcaaaatatagagcaatccaccatttggataaaaataaaacaagtccaaatcaccaaaagtgtgtttgtacacatctgtgcctgtgtgcccatgtgctcatctgcctctgtgtgtgcgtgtgtgtgtgtgtgtgtgaatgaggtcattgtatgaatatgcttattaatgcccaaacacctatttgaaaaaaattatcctgtataggagggaacttggggccagtgttgaaagaggacatttgttttcctgttacactctttggcaccatttgaatttttaaaattatgtgtctatattatttgtttttcaaaaaagaagatggaattacaagtataagacattaataacttctttgtttgaacttttttttttttttttgtgagacagggtctcactgtgtcacccaagctggagtgcagtggtacgatctcagctcactgccacctctgcctcccagttcaagtgattctcccacctcagcctcctgagtagctgggattccaggcatgtgccatcacatctggctaatttttttgttatttttagtagagacggggtttcaccatgttggccaggctggtcttgaactcctggcttcaagtgatctgccagccttgccctcccaaagtgctgggattacaggaatgagccaccgcagccagcctttgaacttttctatgtgacaaatatatgtttaacaatatctgagataaggcagatagtgacttttccttttttctctttgaagaagagtaacattagtttccgagagcgtgaatgtattcccagtgaatgtcgttcgtactttgaatgtttaattgtctgaaatattgtgtttatcttttaaaatgaatttatacaatctatttttgaggtgcagacctctataatttcaccctcctcttttaaatatttattggggaatgtttacgtagaataactttgcagaggctaaaatcacctcttgctttttccttttactgatccaagtcaaaccttgatatgtgactattcctgtttttttttttttttgaatctactaatctattttaaattttaaagtgattctttcctgaaacatagttttgctgcaaacatctcagtgatgtttggcaaaaataagcaaagaaataataataacaaacttgcccttattatcaagccatctaatcagctgaccttattttttttcctctagttgttttgatatttcagcgaacacatagtaatgaagcccaaccttaaatgaacccaagtattcaatctagttactttaagtgctttcatgctgtcccgacctgggcccgggcatttaattttttttttaaccttatcagggtgtttaacttaatatttctgcatttatagataacaacattactcaaaactcaagaggcatatatttctgaaacttcaaatacatttttaaacttaaactatctaatcgcttgactctcgtcaagcttcaaattcttgtatgcttttaatgatccatgagaatattgtttacaaagatgtctttttaaaattaatgcttaaagatattttcttttggattgtgtctgagcatatttttctccaaaaaataagcctaaactgtgcgagtgaaaagaaaaataatatatgctgattagactcttttccctcccatacacatatacctgttcatatatatgtatacgtacatgaatattcacatatacacatatatattcaatgcattcacacatacatatgtatatatgtcttccatgggactataaatattagttttattgttttatgttttcccatcatacagtggtctaaaggcttgagtttacagccttaagtttaaaaaggttgatcaatcataaaattgtatggccaatgtataaatgttgcaatgacagctaggccagatcatgagccaggcaaaccttttctctgatgctttcttgatattcttatccatgcccttgggtcctagcacctagaggtgatttgtccactacacaggggcctaaaccaccactccctccccactggcaggcccagcctgggaatgcacgctcagtgctcatgttcattgcaggtgcatcatggtgattgctgttaagggatctgcctatggaaatagtactctgggactatgcttttatatggaagtggatgatgactctggatataggtgattaggattcatgagaacaaggagctgattcttcctaaagggtgtgtgtgtgtgtgtgtgtgtgtgtgtgtgtgtgtgtgtgtgtgtgatgctctaaagacagtgttggaaagtttgctaaaagtggggaaaaggtccaaattattcaagttcaggagtttctgtttgagaaacacattagagaaaccatcttggagtctcagcaaattgtaggaacaacaattttaattttaagcccaaggatgggacagaagaattgtcctaggaaggacagtttgatgagggaggagatacactgtagctgatcttgaagataaagcaaaacaggccctgaaaaaaaaacaagcttttcatttaaactagactccactgtctatgcatggattgcctaaccacatagtttacactctaagactgttcacaacttaataaattaagtcttaccgaaagggagaaactgcagaagattccagttaaagccaaacgactttagaaggatacttattttccttcagcatcctcagtttggaagcttcttgctcatataatcaaccctccttattattaagctactgtgtaagttcttcatctttttatatgtcatgattagtcttttcttctcatggagtcaaaggtaaaccaagagtgcttgttataatgtatgtgttatgcacgtagttaaacgatgagtactggtatactaaataagatgcttcactttccagagtggaaagaaatacattggtccttgtggaggaagagattgctctgtttgccactgtgttcctgaaaaggggtctcgggtaagtgatgtaaagaccaacatgggcagcattcctgaattttgagaacttgtgaatatttaatataaagtaatcccagattcttggcaaattttagtcctcgataatgtttatgtatttcacagccgaagtttttcacattctaatagcaatctcaactatattagacagtccaggcttagaagatagtctaggaagctgcgattcacccattgttttatatgacactagtcttgtgaattgtcctgtggaggaagggtcctggtgtgaaatggtaactactgggtcaccatcctgaaatatggcattttaaaggctctgagaggtactgaagttggtagaaaaaaatccaagtttgtttggtctttccagacagttgaccacaggactctttcttggattgtcgctattgaaacaagtggcacagtgttctaatgaagtgatagctatattttttgtatgcttgttatgtgccaggcactgttctatgagttcaaaatgcttctgctcattgacttctcgtaagaaccttcttaggataccatgtttgcagtgcaggagactgaagcccaagaaagttagtgtcttgctcaagtccacccagaacgtttgcgttgatgaccacgctagattctctgttctgcaaagccaagaacctctttggttactgtctgtcaggtctcttgaacatttgttaatgtctcccccatgttctgacagcagcccactaattcatttgtgataaagtattagatcaaacaattctctaattacaattactcccacaatctcacaagaaaggagtgtggtatagaagtttgggacaatttttgagtcagatcaatgattcttttgaaatgtgtcctcatccattctcgctgctgtaacagaataccatagactgggtggcttacgagaaatttatttctcacagtccaggagggtgggaaccccaagaacaaggtgctggcagatccagtgtcttgctgaaggcctgcttcctggtgtgcagatggtgtcttctcactgtatcctcatatggtggagagaaagagtcctctggggtcccatttatatgggcattcatccaattcatgactactccgctctgattaattacctcccaaataccccatctcctcctactatcaccttgggggttagaatttcagcatataaattttgggggccacaaacattcagtctgtaacagtgttcaagtcaattgtagggggctgtgcatgacattcaaaaagcacagtacagtaaagaggagtctacaaggacacaaaacactacccacaagagaagggacaacatatttctctcatggtattgcttcatctttacacagcaggtgtgcaatgggttcctttgttggcctattttactgggagcagctaccttattgagcataagttatgacaaatccactgatgcttaaactgctttgttccttcttcagtacatcaaaaattttgttcatcagaatttatcttgagctttttcttttttttttttttgttttgagacagagtctcgctctgtcacccaggctggagtgcggtggcgcgatctcggctcactgcacgctccgcctctcaggttcacgccattctcctgcctcagcctcctcagtagctgggactacaggcgcccgccaccatgcctggctcattttttgtatttttagtagagacgggatttcactgtgttagccaggatggtctcgatctcctgacctcatgatccgccagcctcggcctcccaaagttctgggattacaggcgtgagccactgcaccaggccagagacctttttcttttctattctttttcttttttagacagggtctcactctgtcacccagactggagtgcaatggcatgatcttggctcactgcaacctcaaactcttgggctcaagtgagcctcccacctccacctcccaagtggctgggcctacaggtacatgccactacactaggctaattatttttttgattattattattattattattatttgtagaggtggagtcttgctgtgtttctcaggctgttctcaaactcctggcttcaagtgatcctccctccttggcttcccaaagtcctgggattacaggcatgagccactgtgtgcagccggtcttgagccactttcataatataattttaaaagtgaagcttcaagaaaacaaagtccttagcttttttgtgtaaatgtgcacattatatagaaaaaaagcctggcttttctgtgaggttattaatgtaaatataccaagattgtacaaatgcaaaaaggaaaaaaaacctcagtgcctctaaattttatgactttgagcttcaggaccaagataaatagatttgatcagccctgtggcaagaaagagatgagccgaccccaaaacaaagaggaccagttgctttgataaaggcacctcagtgggtctcccaatgtgaatgaggctgagagttgttttagcagaaaaggggatgctactggtttccagcaagtagagaccagaagtgctgttcaacatcttacaatgcacaggacagtccccacaccaaagaattatccatcccaaatgccaactgtgccaagattgagaagccctgttctaatctcacctctgctctgtgatgcaagtattattatttccacccttcagagcaaggaaactaaattcccaacagttctaaataacttgctaggatgcaggagaaccaggaatcacacccacgtgtctggcttcaaacccagcatttgctccatgatcgtggaaagatcattacacgaaggtaccaactgctgggttgtagcatcactttgtaaacttgggttgccacttgactctgaccaagcctgggtttccttgcacgtacccccattggtccttctcttctatgtccttgggctgttaaacaagcgcaaggcattgcatgtgtagatggtgtactttccaccctctaagcagtctctggatagggaaggctcccagtcctgagcggcactctgctgtgtgtgtctttgtgtctgcgtggtcaaggagagctgtgtgtgccacaacagggagcctgtggtcttcctgagatgaatgggttttccatgggaaggctgcaagtcgttgtgacatcttccagcgaggatttgggagtgtgacttgtgcgtaacagaaggtggtttgggaaagtagcactgtcaagtcctcagcagccggccaaccttctgagctgcagtgacagctcacgggggactatcagaataggaacacaccaaattcctaaggcttgagggatctgcctgaggctgcacagccttcaagtggcatagcgggctattcctaagaaggaaagtgttcctctcttacaggttaatgcccgtagtagcagtaggtagtagtaggtagtagtttcatcaaaccccacatcaaaactgctatgtctaaagcaatcgttgacaggcaaggctggttctgtgctgaggaacggccatggttcgcaatttaactggagaggagagctagagttagaggtggagatggaacaatctaaggtggagaatcaaggggggcctcctttgatgtctacagaatgaagtccagccccatcactgtactgctggaggctcacagtctagccccagcatgagttttcatctgtaatccccattactgcccctttgaccctctccagctgcagcagttgggccactcattcactcttgaagataatctgaatatttccacttctctgcccttttctgagtgccttccaacttgcactctgcctctgtctttcctgttcttctcaaaggagctcagtggagatgccaaaccacaaggcctttctgctcatcacagtcagtgtcgatgtctccctgccagagccccctagcaagctgcttacctgcttctcttttgctgtacttgtcctgccctgctctgtagctctggctggatttgagagtgaatgtgcccgactttattgattagattgcaagcatacacttcttgaaggtggtcatgagaacacaagtaaaacgttgatcctgattcctgacccactgtggacacccttgaaatatagtttgcctaccttcacttctcccctttgtaaactgggggtcattttttgtactttgagattatcacagtagatagcacacaacaggcagttaatacacataaattaagaaactaaaattcaggggccaggcatggtggttcacgcctgtaatcctagcaccctgggaggctgaggtgggtggatcacctgaggtcaggaattccagaccagcctggccaacatggtgaaaccccacctctactaaaaatacaaaaaattagccaggcatggtggcgggcgcctgtaatcccagctacctggaaggctgaggcaggagaattgcttgaacccatgaggcggaggttacagtgagctgagatttcgccatggcacttcagcctgggtgacaagagtaaaactctgtctcaaaagaaaaaaaaaaaatagattccagcctggacaggatttgggagctgagctggtggtcaggccagcatgcagggactctgtagggggatctcccatacccaagagaagagggggacagaattagtggggagcctcttccccaaccctagactttctccccacacactagcatttaagcctgttaggaaatgagtaatctcacatagttcaaattcccttgtgaatttcaggtagggtcagaaataagcactttgagcagcagcaacaaataagagggttgcagctcttggaccttttaaggtacaatggcaccctaagagctccaggctgaggggaggagactggagcttacctccttgatctttttcgggttcagagccctcacctgggatgtgagaatttgtcctaggggggctggttggtcccctcggctctagcagcccatggttctgtgatatggggcgtgggttttcacatatgacagctatttacttggtttcccaaatgacttgtgaccaggccctaacatttccatgaacctcactatggcccatctttaagggtgtgaatgaggtatatcaggcaggattttctattattccttatcagtttcaagggaggaagctctctgtgtttactggtgggctccttgcagggaaaattacatgtccttacaaattagaatgaggaccttttataagttatactttagtaacaaggatgataataaagacactgtccacagttttttccccatattgttttctattcaagggagtataacaattgcaaaattaacaaaaccttatgatgtagtggttttacaaacacggaggtcaaatgacgtaaacgtcaagaattgtcttagtctttttggtttgaaaaccaaaatcaaacgtgagtgagtcattctttcttcggagaatttcaaatcactaaaaaactgcaagtattttccctgcgatctcattcactcatcccttatactcctaagagcttgcattccatgataaaaatggaatttacttgggaaagtttaattactgttaacatttttcatttcattgaattacttgcactcaaagttctagaactcagtctcactatcactcacacagctgtgttttaggacattttctacctgtagcctgatacatggttcagaacaataatttttatgtccccaaagttcacttaagtcaattgtgttccattttgatgtaaacaagttccagtgacaattagaagttggcaaaggtggtctttcaacccctgagcttgttgggtttgcttttttgttcttcttgctatatcttcctcctccaagaactctctggctcattttgttactactggagaattccctggtaaatgaagtccctgtcagagatggcagactcagatgtccttggggaacagctggtgacctgaatgtagtaatggggagaggaggtgctcaggatggggctactaggagctggacggtgcatttgtcatttaaaggcatcagaattcagaatttttaaaaaacccagtgcctagcaattaaacacactccccagtaaaattcagcccaccagcttccagtttataatgtgggcttagcttgttaaagtgtcccccctgtgtcaagaacaggaaccttgatttctgaagaataaaaaacttgcaaaagttaaagcctgaatcttcagctataggatgatctgtgtaggcttgagtaaggatttctttcttttttaaattctttttcttttttttttcttttttgagatggagtctctctcattcaggctggagtgtcgtggcgctatcttggctcactgcaacctctgcctcctgggttcaagcaattcttctgcctcagcctcccgagtagctgggactacaggcacccccaccgcacttggctaatgtttgtatttttagtagagatgggattttgccatgttggccaggctggtctcaaactcctgacctcaggtgatctgccaacctcagcgtcccaaactgctgggattacaggcgtgagccaccacgcctggccttgagtaaggatttctggacagggtttgggaggcctagagagtaaaggaaggatccctgcctatcatttaatgctttttggcgtattaataaattatagtggtagaagtagcagcagcagctgatgtctacatgggaaaataactccaactaactaacatcatttcagtagactgagaaatatctctttaaatccagcatccgtgcatgagaaaagagagaaaagaagcttttatctgcctactacactgtagaatgtattacctattttccaaacagaccgagtctacgtatagagctaacataacaagactctcccctgggaatcctagttgtggtttgggtctgaaggcagttttgggcacatctgccctggtcagtcacctcattaacttgtcagtgatttgcaacagggcctttggtctcctcatgtggagttcaattccacagcaacaactgccaaactgtgtgacccagcatgacccaggccaggctgggtgcggagctcagcaaatgcagggccacactgaacttgttattggcaagaaataagggctagcgatacaggtgcactcaaaagcagggcacagtttgggggaaataatctactatataggaaaatagaaagcacttagtataagaatacctctttagtacaaatgtaacgtctgactaattagctaagatgaggaattataatggttttaggaaataaaagcaaatttctcctttcaaacaaccatattcaataatttgccaagaaatccacaaacagctgtctccaaggtgcttatttctctataacacaatcttttttttgtttattttttattttttagacagagtcttgctctgttgccaggctggagtgcagtggtgcaatcttggctcactgcaacttccacctcctgtgttcaagcgattctcctgcctcagcctcccaagtagctgggattacaggcacacaccaccatgcccggctaatttttgtatttttagtagagccgggatttcaccatgttgactaggctggtcttgaattcctggcctcaagagatctgcccatctcggcctcccaaagtgctgggattacaggcatgagccactgcactcgtcctctatcatacaatcttaatggcaacgaataataataccaataataatagctttccattcattcggcaagtaaccattgagcacttgccacatgccaggcatccaaccaggccatggaggcctcagtcgtaaagaagaaagtccctgcagcctggagctcagagccaaactgagagacagacaagactcccctccggccactatttctggctgcctgaggagcgccaggcactgtttgaggtgctcaagtcacatcagggaaaagatgagacaaaaatccttgctccctccccaggtggacaatttggtgccctggcttgctttgcatgggagcatatcggggtcagggcacagggagctgtgggttagcacttgagcttgaaccgggtggaattagaactctcctagccacagtctgaaggagaagccttctgtcagtttctatggctgtgtaacaaatgaccatatacatggtggcttaatacaacagaaatgtattctctagaggccagaagtccaaaagcaagctgctggcactgccaggctccctccacggctctgggggagaacctgctccttgcctccttccactccttctggtgtcagcagtccttggcattccttggttcctagcggcctcacttcagtctgtgcctctgtcttcacatcgcctgctcctctatgtgtccacatcaatctccctctgcgtcctccttataaaggtgcatgtagtagcatttagggcccacctaaatcacccaggagaaactcttcagctcaagaaccttcactttatcaggtcttttgccgtctaaggcaatagtcacaggctctgggcttaagacatgtcgtatctttttttgtggcgccattcagctccctacaagtgttcagacaaggggaacagcctccgcttgagccctgaagtgggaaggagacaggctagcatgtttgagggactgaaacgtgactagagagaaatttgaccacagtgggtaaggaacccggcagcatgcaatgcagcttaaaaagcagacaggggcagggtaggttggctcatgcctgtaatcccagcactttgggaggccaaggtgggtggatcatgaggtcaggagttcaacatcagcctggctaacatggcgaaaacctgtctctactaaaaaaatacaaaaattagctgggcatggtggtgggtgcctgtaataccagctactggggaggctgaggcagagaattgcttgaacctgggaggcagaggctgcagtgggccgagatcgtgccactgcactccagcctgggcgacagagtgagactccatcttaaaaaaaaaagaaagaaagaaaaaaaaaaaaaagcagacagattttcctgcataataagaaatttttgaaagattttaagaagggaagaagcagattggatttatgttataagatgatctggtgctgtttggaaaatgtggctggtggcaggtaggtaatgttagggaaaacctgttatgaggctgctgcagtcatgcaggtgggaagtcttggtggcttagcgagggggtgagtgtggagggtagggaagtggatgggaggtggacatatttgggaggcagacttgataggaatgaggagactcacctggcgcagttggggcaggcagttagaggcatgcgggcctcccaggagaggtgtaagctgctgtgcagacagtggtgcctgctcaggaagcacgtttcaggggcgatcatgagtccaggtttggacttgcagcgcttgtggtcagttggatatgtgactggcactcagaaagaaaggtctgggttagggagggacacggagggattgtctgactgtgggtgaaattgaccacttggaaatggatgctttggctggagagaaagtgacaagaagccagggcagccctgaagagctctgggggagactccaaacaggaggaagagggggccacaagacacaggtgggagcaaatcaaggcaaggccaaggggcagggatgctggagaacagggcaggcaagaaggagggagagttgagtgggttagagctagtcagggagcttaccaggagcccttagccttgtttaggccccgcagaagacgcagatgccatgttttaaaatgggaaaacccttctccaatggcctggagtaaggggtgaccttgttgttcagtggcaaagccatgtctcctggttctcagtgcagggttcttcccactgcaccatgctgcctcttaagaacacagtgaaaatctcgaatgagtgttactccaggctaaatccctcagttgcccctatttcattgtgaacaagtgcggttactttaaggtacaagaaaacactctgccactgaagtccagtctctggattgtctactgttgataacaccttttgttatttattttgataactcttcctggcacctaacgggcctttttcctgcaataggggaggctcctggaggcactgccaaaggattcgtgagtgatgttgtagtgtcacccagtggctgactggttgaattacaatcaagccttaaaaaggagggaagcattagaaaagaaaggaatgataataataatggattaagaataatgagactcataaaaaggatgaatatatttaaaagaatatttatttgttcattttaattgtggaagttttaattgatcatgtaatccatgagtatatgtttagaatttatactgtgcaagacagtggtcaagatgctgaggtggaaataaaaacgttcatgaatccctggctgcaaaaagtgtaccagaggccaggcgcagtggctcatgcctgtaatcctggcactttgggaggccgaggggggcggatcacttgaggtcgggagttcgagaccagcctggccaacatggcaaaacgccatctctgctaaaaatacaaaaattagccaggcgtggtggtggccgcctgtaatcccagctacttgggaggctgaggcaggagaattgcttgaactgggaggcagaggttgcagtgagctgagattgcaccactgtactccagcctgggtgacagagtgagactctgtctcaaaaaaaaaaaaaaaaagtatactagaagacatcaccccaagcagatattaagcaaagtagcatgcacaaggcaataatgaaaaataggtgatgacgttatttagtcattaattattttagggtagatgtggtagtttggaggggagtgaaattgatgaggactgcagttaaatggaagcagaaaccttgaagtcagaactgaacagtctcaggtcctttgtctcatgtctttgagtctcagcttcctcctttgggaatgaggtcgtagatacagggatgactttctgctttacagggtggtaaggattccatgagaagaatgtattaacacactgttgtgttgtgtctagatttgtacatggtggcagttattactgctactgttatgattataatatttttggagggatggcagaatttgagctacaggtaaagaaaggctactctgacctcatggaaacaagtgtgattggggcagagggtgggggtgtggaaactgcagggaataaggttggcgggtgtgcggaaaggagattgtccccattgcaggtgttggtgaaagcaatgacaccaggaaaggggtgactgaagaagattcattgacggttgcatggggcagtggggagaagatcagggttaaggagacgcgagagattggtgcttgtggaacccgtgcgagagttgacaagaccatgggccaggtgcttggcagtgggaggaaggtaagatgggagcatgagatttgggttttggttcaaatcgagatgtgattgacttggtcatgagaaggacatggagaatgagggaaagagggtgacaaggctggcagctggatggcgagcttagatgatgccaggaacagagttactctcttcagtgacagggaaggaggaggcagagggctgagctcagctttgacccaatgtgtgagatgaattaacaggggaagaggatgcaagaaagtttctagaaaacagttggggatataggataggaccagaaagttaaatttgagaaccacaaaaaatagaggtattcaattaattcaattaataacattgtgtcctaaagaaactttataaaagaacattgagtgtatctggatagactgtttttaagtgtaaaaataagaagaggcttgaagggattgaaacgtcactccgggcatggcatgagcgtgatttagtggatgaaccctccattgtgctaggctcaggctcaggtagggggaagaggagaggtttaggtgagagactgactggtccaggtgtgaatctgagcttgctaggtgtgagagcctgaataagttacaccttccttcatctatatggggatcatagcctacactattcagtgttgctggttgcattaaataaggtaaggtatggagcatggcagccacataatccataaccaagcctaataaatacattccttccccttcctgtgacatttttgatgataaatgtcatggtcttaagagttcaagggtgatttggaaaatctgtataattagtataacaaaagcatctttcctgtttgttcagtttttcatttatttataccttgcactgatttataccttgcatttatttataccttctggctaagaaagagcaggaagtcatggcagaaaaagtgtggctgtacctgtatttgtagttgtttatttgtagtgtttctcctagtgctcctactgacaaaatgacaaacgatttcttagatttttgtcattccccatatgttttggtccctgggacaaccagatcattgccagccaaaaaggctgacttgaagattttggtttttaaaaagtacagtacataccctcttatcttttggtctcttttactaagttgttatgaaataaaagtaattttatcttagccctgttcaagagacattctagacttaggcaaccgacaagggacaaaatcctaaaggaatgccctggcttcagaagacagggaggccggcggttctgtgtctgctctcatctccttcatcctttatttgtacagctggcccgagagcctactgctgctctagggaggcgcaaataacaggtttgatgatacggtgtcaatttggcctttgaaccaaaagaaagaaagaaagagatgatctagtggcttcacatggcatgccaaagtctcctcagctgtcaagctgattgtcatttctggattcagcggctctgtcttctgacttcgaagctgcagaggcagttgcatgcgcacgtagccaaaaaaacccaggggtgctgtgcatctgaaagccagtcattccactgggtggtttttctctttttgctagactgactctggcacagcaacttgttttatagcaggttattgttggtggtggagagtgcagggttaggactgggtgaaatatttctttaaagactttttttagtgatgcaaaattcctgtgattatttaatgattctctagttataaaaatgtcttttatgggcctgctacttatgtctatttgtcctgaagtgaattctattataaccttatgaaaaagtaagcctacatatttacctgtaagcacaagttcttttactgacccattcttttacatgaaacaatttaaagaaaatagaattattctctgtatgctgtgaataaattatttactcaaattaggtgaactaacaaatgactatttcaaagattggtgtttgggaaattttggtgagcagctttctgacagattttgtgctgttatttgaggtttaatgtatttcctttaaaaatttatcatgtagcaaaatacttattaaaatacaaaaaaaccgcactaaatacaaaatcacaaagtcttcacagttgtaaaaaaggagaaatttatgttagtttttccacttgcaaagtaggggtagtgtttgccattgcatatggttgaaataaaggcataacaacacctacattatagctcaacagcaaaaaacaccaacatctctgttattcagagtcattgctcatggtgtgaagttgtactctgcacagtttgctgtggaatcattgccattttgcataattactgttaaccaacgttctaggaatgacaattcagagacataagacagcatttacacttatctctttgcatccatgaggaattggttccagttcccctctggataccaaaatccatggatactcacgtccctgatacgaaattgcatagtatctgcatataacctatgcacatcctcccaaatactacaaatcatttctaggttatttagaattctatgtaaatgctatatacagtatacagttgttatactgtattttaaaatttttaatttttgttgtattgttcttttctgtttattgattttcgaatattttccatctggatcggttgagtcctcagaacgggagccagggatatggagggccgcctgtcttgccttggggtagaagtgggctaccttattattttataaagagtttgttgttctctgcctttcttaccatcatgaccttgggcacttagactcggccttcccctccaggagcagaggttgggtggctgtgggcttgggagggacagacaagtgaagagggtatgatagtcacgggtgagagtgttactgcagaggcaccttggagaggcatctccttctccagaacaggggcaggagatcaggggaatctttccactgcagccttgagagatgaatcagccagaggcagagagggggcgctcccgggacaggacagcctgcgcaaatgctgtgaaagaacagagcttgtctagaaatctggtgcagggaggtcagggtggcaggctgggaggagggaggagatggtgagagagaggagttagcatccttcaataatgcaaataaccattccctgctttactttttttttttcctcccgaagtattttatatgggcagggtgcagtggctcacacctgtaatcccagcactttgggaggccaaggcaggaggatcacttgaggtcaggagttcgagatcagcctggccaacacagtgaaacccagtctctactaaaaatacaaaatttagacgggtgtgatggcgcgcgcctgtggtcccagctacggggggaggctgaggcagtagaatcgcttgaatctgggaggcagaggttgcagtgagctgagatcacaccactgcactccagcctgggagaaagagcgagactccatctcaagaaaaaaaacaaaaaaaaaataaagtattttatatggcattttctcaaatcagcacacgtttctatactaaatggagttttattattcttaactgttgtgttaaatatttccacgccttttttcccctctgcaaacttcccattagctcactggatttggtattgcatgcctaaaatgaaacacattaaagagatttatagtcagttaattggctctctctttttcagttacccttttatattcaagcatgcattttagtatgtatctaaataatacattactgtaaagtactgcattcacaaaagataatttggggaagtttatgtataaactgcatgcaagatgaaaagataattcccaaacttaatgaaaaagtatttatttcctgaattttatatgtagaaaacatgggagcttttagattatgttaattaatcttatttctaacacaggttagacagaaaggtgctctgaagtcattgtttgtttttacttttagatcgtagtttagaatttgtgcagtcacctattgtaagttgataaaccctcacaataccccaaatggtttgtgctcacgtaattacactttgtattttattgttgtctttttcataatacatatttatgtatttaagtttcctttaaaattctaagcttttagcatttatatggatactcaataaatagtagctatttaacaatgatgaatgagcatgaagaaaagggaaaatgcctataaaatatagttttgatttgtaaaatttaggcagatgttaaaggttgtcaatcatgtttgtcgagttaatgacttaatggtgagcaagaagtggtaactaatctttattataaaatcacttctgctgatggtaagatgtacacaaagtatgaggttggtgaagaagtaattgcggtctttgccattgcttttaaaaggcaaaaaccacaattacttttgcaccaacctcatagaatgtaaaattgccctggcttgtgttttcacttatgagacatgcagtttcttttatgtcctagaaatgttcatttataaacatctatttagggaaagtgtctgttcttttgtttctctactggtgggattatatgacatactattctgtggcttgtttttctcctttaacaattatccatttataataataatatataataacaatagttagcatttgttatgccaggcactatgctaaacaccattacatgcattattctttttatgctcataagccattgacagataaagatgccaaggaacagagaggttaagaaacatacccaaggtcacacagcaagtcagtgtggtcctgggcttcaaacccaggaggctgacgcatagcctgggtgctcactctgtttctccctcatgagcttggggaggatgttctatgtcggcctgaacagatggactttgctggcagcttgcacgtgcttttggggtcccacacgtcttcctcagacctgttgtttctgtgctcaggctctgggggacttcagctgctggcatctgtgtctgtcagggctttatccaaagccccggaggcacagttggcaggcactccatacccatcaccagggccctcagccaaggagataaatacccccactcccttcccctagggcgggataacactgagatgtgggctcccctcagggttaagtcccaggtgcccacagtataactgacctgaaactgcccctttcttggctgccttcacttccgtgggtcgcgctctgttcctgacctgcacctccttcacttctcaaatggagaagttggtctcattgacttctcatcctctgtgttgctcctggagcaccctgatgaagtcaggctgtgagggctttcctgtttgaaggcaccctaatttattcactgagtctcaggttggtgcctttcccgtggatttccggtttctcttgctattgcatataacactgtggtgaatgttcttgcactatttttacggggctcctgccccatctccctcctggtgtctgggcctggccaaggccagcagcactatctaaagtgacatcccacctgggcatggtggcttacacctgtaattccagcactttgggaagctgaaggcaagcggatcacctgaggtcaggagttcgagaccagcctggccaacatactgaaacccagtctctactaaaaatacaaaaattagccaggtgtggtggcatgcaactgtaatcccagctacttgggaggctgaggtgggaggatcacttgaactcgggaggtggaggctgcagtgagccgcgatcacaccactgcactccagcctgggaaacagagtgagaccctgtctcaaaaaaaaataataataataaataaaaataaacaaagtgacaccccaagtgtggatcaggaccaggtgggtcttagttactgtttcttctcgtcaaggtgctctctgaccttctacccaatgtggggttgaccacatgaggagctctggccttcatgctatgcgattgtctggggccctttggttgagccctggttttggagggtggctgcctagcagaacacttccatttgcccatgaagtatttccttgatgggactgcacaacattgggttgccagagtagggctggcatgctgatttcgggtgactccagtttttatatagatgcgactctgcaagaaatattttgctcagggccctgcattcccaaggggcaaccctgtattagccctggagacctaagacatctgatctgagcagatatctcctaaaccctgccaagcttttctgtccatacatcaagacttacttgcttatttaatgcagtcatccatgctgttttgtgaagcaagaagttataaaataatttttcttaaatctttgcaaaaattttgagaggtatgaaatattgcaagtcgaactcttgacctcaggtgatctgcccgcctcggcctcccagagtgctgggattacaggtgtgagccactgcacctggtcgggatatcgctttagatggtgctgctggccttggccaggcccagaccccagaagggagatggggcagggccctgagacatgggttctgaggtaggagccccataaagcttcttcacttaaaacaagaggtggccttttcattcatggaaagttggattacataaatttaatgtgacatggagactaattccaaaatatgactaagaaattagataaaagcagccaaaaaagaaatgttgtccttcgaaagggcaggcaaatcattagttatttgaagtaaataaaagatctggcagtttcccttactctatttgtgtcacgaacataaaggtaaataaaactttgattttttagtttcttgcttcattaaaaagcccaagatctctaaatttgattgacagaatgaaaatagtaagataactataatcacttgatatatgtgtttctgtgcacacacatacatacatactgcacacatacatacatatacacatgtgcagtaattgaaatttatcatatagcttaattcagattaaaaagggcaatgccactatttcttatgttttaagtcaatcattttcttttcttgtcttgtttttcctttcatttccttttccttttatcttttcttgtctttcttttcttttctttttttttttttttgagatagggtctgtctctgtcacccaggctgtagtgcagtggtgcgatcagctcactgcaacctcggcttcctaggctcaagtgattctccacctcagcctcccgaatagctgggactacaggcccacgccaccatgcccagctaatttttatattttctgtagagatggggggtctcactttgttgcccacgctggtcttgaattcctgagctcgagtgaacctcgttgtctcggcctcccaaagtgctgggattacaggtgtgagccaccatctccagccatttgtttctattattagagttgtgcaaatctaatttccaagtcttctgtaggcctgaatgagtatatgtttgtgttagaagacagtaattaagaattgcacccccatttctttttaatcttccttctcagggtccaccaggaccaccagggccacagggtccaattggacccctgggagccccaggacccattgggctttcaggagagaaaggaatgagaggggaccgcggccctcctggagcagcaggggacaaaggagataaggtaagccacatcttatgtggagattcacatgaaagactcaccagcactactgcaccattttttgtttttgttttttttagacagtcttactctgtcactcaggctagaatgcagtggtgggatctcagctcactgcagccttcgcctcccaggttcaagcgagcctcccacctcagcctcccaagtagctgggattacaggcacataccaccatgtccagctaatttttgtattttttagtagagatggggtttcaccatattggccaggctggtctcgaactcctgacctcaagtgatctgcctgcctcggcctcccaaaatgctgtaattacaggcgttggccactgtgcctggccagcactggagttttataaccacgagtagtatatacttgaaccttataataaatgaagtccctgaactcctctgcaataattcatcctcatttttggcccctttccagaggagcatgctcttctggacctttaaatacatgtgtgtacccagtgagaagttatattgtttcatggctttttaaaaaacctacatgacattaattatatgcatcacactgagttttctcttttcactcaacaatatgtcttagagaccattccttatcaggctatgtagattgaacttattcctgaaaaaacattgtataatatgccatagtatgaataaaactatagtttattccctgttgatgagcacttgagattctaccccaactttgggtagtgcagatgtgcaaaaataatcctatcaattgcctgtgttcacagttaagggtttgttactctaggatcgagattcggagtgttagatttctgttcacagcatgttgaatgatttacttaaatcagtactgctaggctgttttcccaagtacaaaagaaaagcacaagaattggttcttaaatgttggcttttagactcatcatgtaaaaaataggtgacaatgactgctcagcatgtttaaagatgagtaattaattgttactattttcaagtaaatcagcttattaatttaataatttttatctctttgttttattttctgggattttagggtccaactggtgttcctggatttccaggtttagatggcatacctgtaagtatccctaaattttctccacttttttcaaaaaggcagaagtactcatcaaaatccttaaaaccacatgtatatatacataaaatatatatttatagaaaccacaatatatatattatatatagcaaatatttgctatatataccacaagcaacgtaatatatatatatctttcaccataatatatatctacatatataaaagatatatattagatatacaagatatagaatacattaggttggtgcaaaagtaattgcggtttttgctgttactttcaatcccccacaattacttttgcaccaaatatattgtatatataagatatgtatagtatgtatactatacaatatgtatcttatattttacatatataaaatctatagtatatacgatatatagctatcttacatatattttatatagtatcttatatcttacatatagtttatatatcataatatctgttaattatatattgtataacatgtataaaatatggtgcaagatatatatatgttatggtgcatggtatatattatacatagcaaactctttttatattttctcattttagtgcatgaaagggtgtttacatttaaattttgtacaataactcccagagcaaaacactttacttggaaagcaacgttttctaacaggttagagaaaaaattccaaaatatgagctaggtatacttgttatgtcaagtacagtgttcttgaaattaatgcatactcataaggaatgtttttatttgctgatgagtcctaatatttgtagtgagcttaatactcccatttctcatatgaaaatggaatggaaaaaaaaaaagaggtatgtgggggctttataattcattatagtatttctaaggattttaaggaaggtcccctcctcaatttcccagagtactgcaaactaaattagtttaaatttgttatcttaaaaaaaatttaggttttatttttacatgctacgtagccttttggggtaaagagaaagtttcacaaaactaaacagtaaatgtgtgaatcacaattgccataatttgagtattcatattgcataacctttatgtaatgatattttcgcaaaaatgcttcacttataattttgttttctgcaggggcacccagggcctcctggacccagaggcaaacctggtatgagtggccacaatggctcaagaggtgacccagggtttccaggaggaagaggagctcttggcccaggaggccccctagtaagatacccacagttcatcttaacaggaatcttaagtgaacaggccctgtggtggaacaggcttgatgtattcaagaaacagagttaatacaagtgtgcctggagcattgtcaacaaatgggagtggctgggggataaggacagagagataggcaggacttagaacatgcaggactttgtggatgatggaaggaggctagattttcttatccatgttaggtaaaggcactggatggttttaaggaaggaagcaacatgatctgattgatgtttcattaagatgtctctggctgctgtgaagagaatagatagtagggaaaaaagagcagagagaccaggtagcaaaatgtaaattgtttatcattcagggttaattgcagaaacaaaccccactaggtattttgaacagaaagggatctgctacagggattctggcacttattataatagttggaagagtaaaacttaggaccacacgagaccactgatttcaaaggttcacagctagctgagatccggagtcaggaagctgtaactgcactgtaaccactgcctgtcaccccacgtctagacactagcaaacagaacactcaagtttctgctttcctgcttggcagcaacaacagaccaggaagagaatctcttccaaacttctgccttccacatctcctaggtggaacctaattcacatccagctataaaggagtctgggcaatgtagtttttatctttctagcccctgtaatgcaaaaaaatatattagaaaagatttggaatggatgtccagcaacagttgatagtatccagcacttgggggaaaacttacggctcttagctttttttttcttcagaattttggactttcatttaaacataactggagcaagagctaccccccatattccctttctttctctctttttctttttctcacttaaataaagatcagagattatttgacctttccaaattgtttttctgtgatttttttttttttagcatttctcccttccttaataaaatatcatttcacaagtttctttctagaaagttttcttagcatgaccaccataatcattcattctgctgtcactcacgagtcttccttttgctccagattctagaggaactgatctgaacactaaactcaaaaagaattttccatactcacatttttcttctggtatcaaataagaacatccaccacctttcattgttaagtttttcaaccatcctttactttcaaactcagccatttgaaaactcaagtgcagtctggtgaatgcacatttattaagctcctcaaatcaggccaaacctcattctacagattcatgagcattcaagagagcaagggttctcagttttaactttaacatagcatgcagtaccagccacaatcctgaagtttgtcataatggtctctttgcaaagcaaccaacttccccttgactcatttactatacagacacccctcactttgcacagtaaagtaagaatgaccaggcaagctaaaaaccacgcaaagaaaccttatcaactgatgagaaaattaatattgtcccatgacttttaaaatgttttgttaaaacattagaaactttgccagttatataaggaaatgaaaaaactaaatatttctttaatatactgtaatttgaagcattgagaaccaaagtgttttatttctttgtaaaaacttatcaagagtagtttcaacagtacttgcctttttctcatcatgtaacttgtgatactaaaggaatatgtcttttatgttttgaggaagtatgatactcctaagttcggatctgtttccagtgttgtgaaatatctctcagggttcctttaatgtgaagttttcatctgtgtcactttacctaggacgctgtcatccttttcatcacaaccactttcctggtttctctttactaagttcctctggctgcaaatagtctctcaaatgacaacaatctcattattcccatgatcagctattgcttctataactccacttatgttttatttgaatttcatttccagcattaccattttcatttctttgcttcattttcatcattattggccgatttcctcttccaactatccatttttgtaaaatgttatttgggtttattgctgggagataaggaggcaagccagctacaaactttgctgtctgtgtctgtgtgtgtgctctgaataatacgtgtgcaggggccaatcacagacagactttgacagaaatcattgaaactgacccattagtcccagagatgttctttggatcaacatagaaatggatccttctgatcttaaagtttgaaacctatgtgttttatctgagttccttcctcaggagaggacccccaggcctctcaagaagtatcaaagaactgaaacacaccagatcatggcatccagacaatgagatgccagacccctgattttgtttccttacctaggtcctgttttccaatacattgttacgtttcttccctgctatgtgaacccctaattttagtcagtccaggagatggatttgagactgatctcccaactcctcagctgcagcacctaattaaagccttcttccttggcagtagtcgtcctctcagtcattgactttctttgcaacatgttttggtaacatcacgtgatcatgcagtaatcacaattcacatctgttatttatatagcgatttgtgggctgagaggatagcaatgaagtttgtacgttatgcaagtactcaatacacaatggtgactgaaatttgaaccatgttgttggagaactggtgttatttaacttaactatgaaactgaaattcattcagactggaactgtgcaaagccaaaactgcagatactaccaaacctgatttctcaagtaaattgttgatgcaatttaaccttatgctgttaaatatctcccatcagaagccaagtcaagcactcctctaagagagattaactttgaaatgtatatatctttcatatgagcttgatatataaagatggtaggatttttatgtggtaaccaagagaagatatattaagaattgaagtaggggccgggcacagtggctcatgcctgtaatcccagcactttgggaggccgaggcgggtggatcacgaggtcaggagattgagaccatcctggctaacatggtgaaaccccgtctctactaaaaaatacaaaaaaattagccaggcacggtggtgggtgcctgtagtcccagctacttgggaggctgaggcaggagaatggcaggaacccgggaggcagagtttgcagtgagcagagatcgcgccactgcactccagcctggtagacagagcgagactctgtctcaaaaaaaaaaaaaaaaaaagaattaaagtaggatattaagatattaagtaggaaaaccttggggaggggaagaatacactgaggttatttcattcacttttaaaaaatatcctaagcaaactagcaactatatacaaaaaccttctgaaaggaacatgttatgtttttaaaaataattcttaggcctattttgaatacaagtactgaaatggataaaatctctctctctatatatatatatacgttttactgtttctagggcataaattaacaattgcaaaattagttatttgtaggaacaatgcatgtgttttatattgtaaggaaatatgaaaattttctgctaaatagctatatatgagtagatattctgtcttagaagattccttaacagatcttaactgaatatggagtaaatatatgtgagaaccttagggtgataataatatggaagaggatacagaaatgtcttcttgttaatcatgtcaataatggtaattttaactgatgagttatattttatatagaaaagaaaatactgaaatggtaatatgctattttcctgttaagtacatacatattttattttcagggccatcctggggaaaagggagaaaaaggaaattcagtgttcattttaggtgccgttaaaggtattcaggtaagtattatgatcatgatgggttaaaaaattttttcttccaaataggtaagcccatgcaggaaatactcagacaggatttttcttcaaaatgtccctgaatacaccaatttttatcattaccctgaccctcagggatggcatcatgcttttgtgtgaaggcagtggctttagtcgccagtaaaattccagcactgtaaaattccattacttctgaactagtcagaactgcaagggatgtatttatttcaaggtttctcaactcctgacattgtgggccacatattcatttggtgtggggctgacttgtgcattataggatgttgagcagaatccctggcctctggcctctactcattagacgccaatagcatcccccacctctgaactccccaaagcgtatatccagacattaccaaatgtcccctggggggaaatcaccccagtggaggaccactgatttatttgtaattaaaacattgtaatattagtacttgccatccagtacagtaaaagtcaccattattgaacttgaaaatgatgtaaaccttatagcactttgcttgatacatttaatggtgttgtgttttcagcagggagtgatgtccaaatgttcagaaataaactcttgagtgaccacctcatctctcagatgagaagccatggatgagtgatggggatcagtggaaatgatgcattaacaggaaaatacagcccatgttcaagatgtgtggtcatttctcttaaggaagaatattctgcagcaattagatagaactagtcctagattgcttctatgagaccctaggttctgtgccacgcagaatggacacacctgagcagtgatccctttagtaagctcactgtttatgtgtgtagcctctgtgcctatttgtccttcttaaacagcaagaacgatggatttgtttatagcttaaatgatatattaataaactaaacgtcaacagcagggtcattctaggaaccaggatggtgtattggaaggagagaactgaggcttactctccactgtgactttaagcaactcccttaacctcctcagcctcatgttcgttatttgtgaaagaagattaaaataatatttaccctgcccctttcttagtgttgttaagactgttataataatttatattgcagcacattgtaaatggtaatgtcccatattagttatagtgagcatttttttgtaattgtggtaatagaggacatgtgacatacaaatatagaagggggatgaatatagagaattccttatcttaaggggaaacagaagatccctaataaaaatgatctgtagatcaataacctttgagagacaatgctcttaagagtctatatccactttatactcattctaatggctatgataaaaaaaacaaatctagcaattgttggcaactacatggagagttggagccttatgcattactggtgggaatggacaatggtgcaacccctgtggaaaataatatggtaattcctcagtaaattaaacatagaattactatatgatccagcaattccacttctggatatataccccaaagaactgaaagcaaggacttgaatggatatttgtacatgcatgttcatagcagctttattcacagtagccaaaaggtggaagtaatcgtgtccatcaacagatgaatggataaacaaaatgtggtatattcatccaaaggaagactgtaaaagctttaaaaaggaaagatattctgacacatacaacaacatggatgaaccttgaagatataatattatgctaagtgaaataaaccagtcaaatatcatatgatttcacttatatagaaaaatagtcaaattcatacagatggaaaatagaagggtggttgccagtggctgcagggaagagggatggggagttagtgtttaatgagaacagagtttccactggaggagacataagagttttggagatggatggtggtcatgggtgaataacaatgtgaatgtacttaatgccacttaagtggcattaagtgaactacctgtacacttaaaaatggttgaaatgggccaggcgtggtggctcacgcctgtaatcccagcactttggaaggccaaggcgggtggattacctgaggtcaggagttcgagaccagcctggccaacatggtgaaaccccgtctactaaaaatacaaaaaaattagctgggcatggtggcgcatgcctgtaatcccagctatttgggaggctgaggcaggagaattgcttgaatccaggaggtggaggttgcagtgaagggagatggcgccactgcactccagcctgggtgacaagagcgagactccatctcaaaaaaaaaaaaaggttgaaatgtcatattttaacttacatatattttacattttaaaaaaagaggcttcattcaagagaatatatagcctttgatcttttaaagtaggttgagtctcagcacagagtcacaaggcgatagaagtagacagaggctggtgtgaggcaatttccacctgagtttcttttctgtccactctagggtagtcaagggggtcaagatgtttataaagcatagcaaggtgtggaaagacaccagcaacaggtaaactgtgaggaaacgggaccactggattgagaatttagaacaatttaaacaaagaaaaaatctcattttgattccatgtcattacttcagcgacctttctctgttgggtagaaggagaattcagagcttaaggagaaggaaaatcacctccgcatatcccttcctcaattttagtcaacaccaaaaaaattgaacaaactgcagttagatgagtccagataattttgtgtatatttctatttttacataatctctgttttaggaacattgtgtggacttaaagcaatgcattcttatttttgcagggagacagaggggacccaggactgcctggcttaccagtaagtctcctgagcaggctctatgcttctatttcctcctcaaatagcctatgatccacgttttaatcccagcaaagccagctacataatttgtgcggctcacctagtgcaaaatgaaaatgtgggttccctgttcaaaaattattaagcatttcaagatggcgaccacagaacatgaagcatggggccctgtgtaactgcaccagtctcatgcccatgaagctgtacttgaagctcatcaagctccctcctgccttcctcttctgtcttctaatgatctcgtgacattactcaggtatatgcagccacttaatatttaggaaagtgagtccacttagcaactacatgtataatatataccagctagaataatcttgcattgcttctcgctaccattttgcctggtgaatcagtatttgtatattatatttaatattttgcccatcttcatctctctgatgtttctgatgtgagaaagtttcacaaaactaaacagtaaatgtgtgaatcacaaatgccacaatttgagtattcatagtgcataatctttgtgttatgatatttttgcaaaaatgcttcacttataattttgttttctgtaggggcaccgagggccgcccagaccagcaattcaatgattatattagtctttccagtttttcgatgtttacaagactaaaattgagagcagttttgccggccaggcgtggtggctcatgcctgtaatcccagcactttgggaggccaaggcaggtggatcacgaggtcaggagtttgagaccagcctggccaacatggtgaaagcccctatctactaaaaatacgaaattagccaggcgtggtggcgcgtacctacaatcccagctactcaggaggctaagccagggaatcactcgaacccggaaggcagagcttgcagtaagctgagatggcaccattgcactccagcctgggcaacaagactgaaactccatctcaaaaaaaaaaaaaaaaaaaagactgggtgaggtggctcacacctgtaatcccagcactttgggaggctgaggcgggtggatcacgaggtcaggagttcaagaccagcctagccaagatggtgaaaccccgtctctactaaaaatacaaaaattagccagacgtggtggtgcgtggctgtaatcccagctacttgggaggctgaggcagagaactgctaaaactcaggaggcagaagatgcagtgagccaagatctcaccactgcactccagcctgggcgacagagactccattttgccttccaaaagttaagctataattttgccctgtaacttctggctagtgatggaacgactttcctgggctggtttccttactacgattgaagctcaggtccatgtaataaatgtgatacctcaatgttgctgttaaaataaatatcagttcatcctcctaaacagagtaatttcattatacactccccaatcatttgacctgggcagagtcagcaggagcccggggaacatctctccacacttccaggctagcctggctgtaacctttccttgacaatttgtgtatagttgtgttacaacttacatgttgtagaaaattttgtatggctgactcatcttgatctcaaattagggactatatttccgcaatttgagatcttgcagaccatgttttaaaaacatactaaaaagtataaatacattaatatataatgttaattaataataatactttaaaagcatcctgatgtatatcaaaattgtaacagaatttaggagtaggtagtaatgcattttctttgctctccacttttgttattacaggatgtatttgtaaataggtagattgatctctgggtcttaactggaccctaaatgaaggaatttatcacaactaccagagtgctgctacctttagcttggtgctttttttttttttttgagacagagtcttgctctttcgccaggctggagtgcagtggcacaatctcggctcactgcaatctccgattccctggttcaagcgattctcctgtctcagcctcccgagtagctgggactacaggcgcctgccaccacgcccatctaatttttgtatttttagtagagacggggtttcaccatgttggccaggatggtctcgatctcctgacctcgtgatctgccccacttggcctttcaaagtgctgggattacaggtgtgaaccaccgtgcccggactgcttggtgcccttttagggctgcatcaaagctgctgttgaaaatgtcctagcagggcagatgtgctggtggctgtgatttctttagaggtttttatccacatgggatcacacgcaactctttctgtgaaagatgattacaattttgggtaacagatgcactgatttttctcatgtttagggatcttggggtgcaggaggaccggcaggtcccacaggatatcctggagagccagggttagtggtaagtacagcactgctgatgtgatccctttaaaaaccagattctacatgaaaataaagaagcaacattgccattttgggtcagacacaggtgggccgtttgagagattataatcgatgaatcagtgaaaacccaccattatcagtgggactccatcttgaagcacaggtccctgcggatgagccactgacatcatcttcacagaaaacagcccatccatgatagaaactccatcactgcatgttttaaaattaagggtttcctaaataggaccctattttggggtaacaaaagaaggcacattctgatttctatgtctgatgattgatttgtgtttttttctcccttgatttagggacctccgggccaaccagggcgtccaggtttgaaggtaggcagtcatgagcaagatacatcaatagagccctgaacaatgaaatggttgaccactgatatttgtcagaatgatggctttcctcttatcagacttcccaaagtattccatgaactgcaatatattgtgtagccagaagtcttaattgcttttaattacttttttaaaattcaaaagcaattagattctttttcatttctttctcagggaaatcccggtgtgggagtaaaggggcaaatgggagacccggtaagaattccctcttgctctgaggagcagatggtgacgtgtgtgtgctgctcaggggtggaggctgttctgattatttgaacttgtactcattatctagtcactgcccaattttatggctgagaacttttctttgccgaattattatggcaccattacccttgactgtaaaatgaaagatctgacacaatttaacactactttcgggttaatttgtgcaacacatttcaccctagcaaacagattgaacatttttgacaatatattatgtccagagtaacagctttgtcaaatcacggatttgttttgcttaatttcacataaatcctaaactccacccttaaatatgcatataaatacaaatataaatgactggaaccaagagcactgagcaatacacaatctccaacccactccttttctatgcctgtcctccccgtctcctccccctgccactcacacccactgtccttttggccgacatgtaaaacttagtaagaataagctttagaaaagtgatttaagggctgagcacgatggctgatgcctgtaattccagcactttgggaggctgaggcgggtggatcatgaggtcaagagactgagaccatcctggccaacatggtgaaaccccgtctctactaaaaatacaaaaattagctgggcgtggtggtgcgtgcctgtagtcccaggtactcgggaggctgaagcaggagaattgcttgaacctgggaggtggagcttgcagtgagccaagattgtgccactgcactccagcctggtgacaaagcaagactctgtctcaaaaaaaaaaaaaaaaaaaagaaaagtgatttaagaaggcaactcacctggaaacaatctgaacatccagcagtaggtgagtggctctttcaacaactgagggcaagtcaatattaagcatctgctccatgccaagctaggactgacactgggtgtggggatttagcaagacagacctgatccctgctctcatggagttccagcgtgattgagtaagtcatggtacagtcatttaacagaacggcacaggagtcaaaaatatatataacgacttcatgatgtggggaagtgcctgtgatataatgctgaacagaaagtacaggttacaaaaatataaactcaactttgtaaaagcaacagcaacaagaaagacattaaaatatacacagagagggatttctcaacctcaggctgctgctatttcattgttgtggaggctgtcctgtgaattacaggatgtttagccacatccctggcctctccccactagatgtcagtagcatcccgtccctccaattgtgacaacttaaaatgtatcaaaacattgccaaatgtccctgtgggaaggggttgcctaactactttccccttcccccaaccttgagatctctggcttgtagaaatgactgaatgaaaatataccaaaacaatgtttttcaagtttgggaagccatggagctctggaatatgttcgtcgaagccacaggagcccgtgtgccattgcagaatccagcaagcattggcatcttagtgactttccgcgccagtccaatcagacacatttgcaaactcaggctgtggaataacttggaagtatttggctatgaggtggccattcaaatgatctcaaatgtgcttaccttaattcttttagattgtcaggtgaatgaacacataattttacaattttgggccaggcccagtggctcacgcctgtaatcccagtactttgggaggccgaggtgggtggatcacctcaggtcaggagttcgagaccagcctggcgaacatggcgaaaccccgtctctgctaaaaatacaaaaattagccgggcatggtggcgtgtgcctgtagtcccagctacttgggaggctgaggcaggagaattgcttgaacctgggaggtggcagttgcagtgagccaagattgtgccatttcactccagcctgggtgacagagtgagactacgtctcaaaaaatataaataaataaaataagataaaatattgatgcagaattctcagatgttctagagcatgtttgcccacctcattttaagaaacactgccctaaatggttgctatttatgcctacatgatataattatggaccttttacattttaattcttcatagttttccttctttgtacttttgactatgctgagtatatggtacttttacaatatgaaaaaaatagcagtatgaccaatattttgaagaagccggctgcttgtcagcttttaagggttttgttcaggtttatctcaattacaagaataagagtggctatctttaccaatacatgctatgcttttactcatgttttgttaatgtgcttgttcaatggtttattcacacagcagatatctttagggcaggtgctacaccaacactgtgttaggtgtgtagataaatcaaggaaaaaaaaacaaaacagacaatgtttctaatctggcttttcttcaatttcccaggtttaggtagaaattgaactcttttttttttttctatttaaacttgatattcttctaaaaattccacctatcaaaagcattagtagttttagtaatgatatattggggaatttactttgttaccctcaatacgggaagcattttatgtatattatctattcaatggaagaatagtttgaggtaggtaatattacaatctccatttcacagagaagaaaaatgaggtttcaaggaagtaaggaaatgaggactgagagaggttttaaggaacttgccccaagtgacagagccagtaagggcctggtttgcaaacatgggtgacctatgtatagcctgtttttaactatgacaaaaagaaagatcatactaagtgtagaataatagtaatacccagaaaagcacaaaatatttattttctaattaatggtgagaatttatgattgtggcaaaattcattcaagaaacattcttttcttcagtagaaaaacatctatcatggcataaataaaaattttggctattattttacagttttaaaatattattgaaaataaatagaaataatctaatctaaccagagtgagatggcttaatacatcacagtacattcttgtgatagattatttattggcactaaaaatcaggattgttacgtgaggccaggagtttgagaccagcctggccaacatggcgaaatcccatctctactgaaaatacaaaaattagctgggcacgatggtgcattatctgtaatcccaggtactcaggaggctgaggcacaagaatcacttgagcccgggaggcagaggttgcagtcagctgagattgcgccattgtgccccagcctgagtgacagagaacactctgtctcaaaaaaaaaaaaaaaaaaaaatcaggatcctgaagagattttagtataatagaaaaaggctcacaaaatattgtaagaaaaatataaaattatttaaaaatttaataaaatatgctgtatattttaaatcatgtttatatatttattatagtattctgattatattttcataaacataaaacaaattgtttattcacctatatacacatatatgtacatatatacacatatgtacacacaccaccaaaaattatatcaaagttttaataggccgggtgcggtggctcacgcttgtaatcccagcactttgggaggccgaggcgggcggatcacctgaggtccggagttcgagaccagcctgaccaacatggagaaacccccgtctctactaaaaatacaaaattagccgggcatggtggcgcatgcctgtaatcccagctactctggaggctgaggcaggagaatggcttgaacccgggaggcggaggttgctgtgagccgagatcgcgtcattgcactctggcctgggcaacaagagtgaaactccatctcaaaaaaaaaaaaaaaaaaagttttaatagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttttttttttttttttgtatttttagtagagacagggtttcaccgtgttagccaggatggtctcgatctcctgacctcgtgatccacccacctcggcctcccaaagtgctcggattacaggagtgagccaccgcgcccggccctggatagtagcattaagaatcattttcattttttaaatttatttttaacaataagtgtgtattaaatttttataagaaaataaatatccttttatattctatgatgtacttgccacaacttgtattttaaatccatgacacataggattggaagcattataccacaatacatgggtgaaaaccttcaaaacataaattaatatgaaattttcattatcttgcttttttttttaagggtgaggttggtcagcaaggttctcctggacccaccctgttggtagagccacctgacttttgtctctataaaggagaaaaggtaattcccaaatccatatgtcaccttggaaagtagcagtagaaaatattttttgacatggatctgtggcagcaaagtatagaggtctttctatgcatcactgcactagtttcaaacctactttaataagttgggactactgttggccccatcgtgcggcattgaaaatgaggcttggaaggttcccagtgttctcaagtttacccagctgctgagtggcagacctagctcaggctgctaaattatgacatgtgcttgttaatgttgttttgacgtgtggattgaaaagaccaccggaagcccagttgtcctttagatgttacagatgagtttgatgtcttgataattgagaaggtaacaaatgcatagaactgggccgtaatagattcttggcaaatattaattcctctgtcagctaccagtgctggtattattggtgccacatgcagattctattgttgcttttccattgctgggttaaatttctttactttgctcaaaataagccactttttcaatggctgcattcccaaattgtatctgctgcctggttccgtggtccactgtggtatcccatatacctctcacatagagaactggctcaaatagtatctggtttataagtgtgctaattagaacaggtgaagagtaatctcttaagatttttttttttaaggtgaaacagattgtaaaaagagatgatttctgaaggagatggaattcagtatgttaaataataagaatagaccaaattatattcattgtaatttttagggtataaaaggaattcctggaatggttggactgccaggaccaccaggacgcaaggtagtttatttaagtacctttttttttttcatttgtgtgatgtactatcttaacttaaaatgttatttctcatggtctttatcattgctttaagtgctaatatatattaccagaatttttcactatcttatcataatactatagagcttctattctaaagtagttgttttctttaagctgctgacaataatttttgtttctcattttgttttttttccctattgctgaaatattgctttccctattgctgaaatattgttgcttgaacccctctaaatgttgtcatctcttaaagggagaatctggtattggggcaaaaggagaaaaaggtattcctggatttccagggcctcgggtaagcatcatttgctgttaacatcagtgaatttggagatatttctctttcatgtttttataaaaccaggtcagtagtcccacaagctcaaaagtgaagaatagctcatgtaagaacaaaacattttggacgagaattatggaatatctaaatatcccagagcatccttccattgacatcatttagataaaacaggcaagcaaaagatagaagaatttgggaaaagtgacaggattgtgccatctcttgtctggcacctcagtgcagtaggaaagtagcttggaatagttaatttaagtctatttgaggaaacaacatggtgatataggggcaggagctagaaaaaaagtacaatattaagctccaaacatcaccacatgtcactaatagaaagcccactcatagagtcaccatggaggccagaccgcagctggcatgggcattgagtttatttggttctagatttagtactgaatggggaaatattggtttccatggtcatttttattgctaatgatgcacagagcaactattaatttccaggcaaattatattgcagagattttaaagatatttggcccagtgcaagcactaagttaagtaaattaaatttggaaaagcaacgacaacaaaaatacattcttaattaaaacactggcaatgacatggattttttgaataagactgaggatcacttcaagtagcaaatgttataaagaaatggaatctattttatatttatttccttttattcagctagctttgcaaacaggaccaaatatccatggaacaatttgataaggtgaaaaatgatgcactgagctggttaatgcattctgatttaattctgtttatcctgatttttgtgaatttattagggggatcctggttcctatggatctccaggttttccaggattaaaggtaaatgtacctcattatagagataataaatacatttcattagtaaatgcaatttagtataattcagaagttgtactgttgcgtgcaaacacagtaattaggaaggcagacacattcattttatggattgcaggatttagctgtgggtgcaaaaattgaagcacaagattgtctgatgcaactgatgaacagtgttaagactttgcatggtctcagtgggcaatgtgttgcttaaattaaatgagaatgagataatttgtcacccagtcactttttttttttaaggcatgtttgtgcttgtttgtagggagaactaggactggttggagatcctgggctatttggattaattggcccaaaggtaaaaagtgagcctattttaatatatcctgataaaagtttatatccttaatattatctaatttatttttagaagtattgccaggaatcattcaagaatgtaatttttagaagagatacagttaattttttattcaattgttacattagtctgtttttcatgttgctgataaagacatatccaagactggacaatttacaaaagaaagaggttaaatggacttacagttccacgtggctggggaggcctcacaatcatggcagaaggcaagaaggagcaagtcacgtcttacatggatggcagcaggcaaagagagagtttgtacagggaaactcctattttttaaaaccattatcttgtgagactcattcactatcacaagaatagcacaggaaaggctgggcgtggtggctcaagcctgtaatcccagcactttgggaggccgaggcgggcagatcatgaggtcaggagatcgagaccatcctggctaacacagtgaaaccccgtctctactaaaaatacaaaaacaaaattagccaggcgtggtggtgggcgcctgtagtcccagctacttgggaggctgaggcaggagaatggcatgaacctgggaggtggagcttgcagtgagctgagatcacaccactgcactccatcctgggcaacagagtgagactccatctcaaaaaaaaaaaaaagaatagcgcaggaaagacccaccccccataattcaatcacctcccactgggttccttccacaacaggtgggaattgtaggagttaccattcaagatgagatttagctgggggcacagccaaaccatatcagttgtcccttgttatctgtgggagattagtttcagaacccctaggctaccaaaaccctcagatgctcaagtccctgatgtaaaatgatgtagtatttgcataatacttacacacgccatatcttatattttaaatcatctctaggttacttataatctctaatacaatgtaaatgctatgtaaacagttgtcatattctattgttttattatttttatcattggattgttattttttttaaaatattttttataagagtgctgactgtatagtactttaatgcatgctgtgtgttattatgcatgattatcatattatcatatcagtgtcatattaagcattattatgttctacatttgagaagtgatccttttgaaggtgaataatcatgagagtttaaaaaaattcataggctcattgagattagaaacagagggcatcttagagagttttctgcttttaacaccactgcattttttctttcctttttaacttttgtgacctcatctggcacttgctcagcatgtgcaagggaattgtgttcccttaaagccatggtggcattaaaggaacacaatttagagggacgctatttgttgctaaaataaaatgtagattcggaccttgttaggtgaataaactatttgtcatcgatgccaagttagacattaatgctcatggtatatctaagaaacttggtgacatcagaggtatccaatttataggcatagaataatttcactggagttaaatttcttttcctttgtagaagctttgtgacttgctatttacttccactacttgtagataagagattagatgcatctttgctgctcctaagactccatggatgcttcatttctctagtcagcctataatctctgcttcttatatgaatgtgcacatgatcgttctaatactggtttaatgccaggcaacatgagtaaaattaatattcctttaaaaagtgaatgaatgaatgatttcagggggatcctggaaatcgagggcacccaggaccaccaggtgttttggtgactccacctcttccactcaaaggtttgtgttcctattcagttcctccataaattatgcagaaataggagttgagtggccaggacagaagagtctggcccagtatttccatagcttgcacactaggcaggctgaatgcacgaactgtagcatgagtgtataattatacatgtgcatgaggtttttttcagtacatatactgtatgctgggatttttattgttatctttcagaaagtctatttttaatcgctaaaaattgtatgaaactattttactggctgggttcagtggctcacgcctgtaactctagtactttggaaggctgaggcaggcagatcacttgaggtcaggagttcgagaccagcctggccaacatggtgaaatcccatctctactaataatacaaaaattagctgggtgtggtggcacatgcttgtaatcccagctacttgggaggctgaggcacgagaatcgcttgaacctgggaggtggaggttgcagtgagctgagatcatgcactcctgcctgggcgacagagggagactccgtctgaaaacaaaaacaaaaacaaaaacagaactatttgactaacacctatcaagatgctgccaccaaaaggagtagcctaaatcagtgacaaagaaccccattcaaagttcacgtgtctgaggaagaggcacagccaaggcggttcacatttaagatatttcgttttaaatgtaatgagaaactgcaaaaatgtctcctaattatactttactgagtctcacaaaaagtaattgttgtcttaattttaaaatgcacataccatttgtttattctcatgtaccattatctttggcaggcccaccaggggacccagggttccctggccgctatggagaaacaggggatgttggaccacctggtcccccaggtctcttgggcagaccaggggaagcctgtgcaggtacggatgccctgatgtgccctggcttttacaggtcagatttcctgcatcatcatcagcaccagtagctttcaactgtagctgatattggaatcaccttaggattgtgtaaaataataccgatgcctgtgcacaccccagaccaagaatgttagactcttgggagatgggcctggggatctgatactgtagaagcgctcctgtgtctgtaacatatagccaaggttaagaaccactgaactcaaaccaattaatcacttacttgggaggaatacaggtttctcagctgcaccccagaacattcaatcaatatcataggggtgttgtaaggaatatgtatgtataacaacaggcctcccacaaagttatcgcatgcagataaggcttggaaaccactgctaggattagtgtttccccatgttttcccaccctgctggaaggctctccctgttgacatctacttgtaaaatttagtacattcacctaatcccttgcttaaatctcctgcatgaaaggtggaagtaaaaattatgattaaaaaaactttcattcataattactttaaaaaagtcttcttccctcgcgtcaaaaacaaaaataagaaaatgatgggccacagtggcatttggtaaaaagcctgggaaagagtcctgttggcataaggactttgaactccttcaggtgctgcgctggttaatattcctagtaagattaggaattgaagtttagagggtatttgcagtctgtgaacccaggagaactgattaaacctgtgaggagaaaagtcttgagtaaacgtagttttacccagcctgtgtctcttgttatatttactgagaagaagtgagaaattttctgagatattcaactgctaactacaaaactcttgtttaatcttccatgaatctagctttcagtttgcaggattcaataaccacaaaggtggaaaagctttgtctagttcacttaacctttagatagcacagccttggcctaactgacccaggagtatataaataatatagagtattccgttggtcagaaagcactggactctggtcttagaattctccaatcaggcttgtttgtaatagaatagtgtctccagcatattaaaatgaagatctaatagtaagtaacaagtgtctctagtggattcaaacccaggaaacctcttaattcacaaggttttaaaaaataaattaacccaatagctttcaaatcttgactatgacccatagtaagaaatgcatttgattttacatttatatgaaaaacatatacatttatattacacaaacatgtatgtatccatatgtacaggtgattcagacaaaaatacacagaagtatacattttcggtatgtgacacactcttctatcccattcatttcttttataataaaaaaaatttaatgctgtcacaacttactctattgacttcatgctctacagttgggtggacaatactgcaagatgccacacactgtagcccattctccctgttggcaggtggttaagcattcttggcaatgggacaaggcagcaggcagcacccaggttcatccaatgactgattgtattgagtccacatcaggtcttagaaatggcatgaagacaagatggcagccaaatccacaggagctcattttcattttgttctaagcacaggagtgtatctagtcctattatatacttgtatatataatttgtagatatgatagatattattgttaatatctatggtatttactatatatacaacgtatagaatatcttgtagataatttggtaattatctacagtatttaccatgagataagcacagtttcagagtcagacacttgtaatcaaatcccaccttagcatttagtgaaagccatatagtataatgtggtacagtgaaatacttaatgcatttgcactatgaactagaaaagttccaatttctcctacttgcaagctgtgtgatcttggacatttattaaacctctctgtacatcagttttcttatctgtaaaacaagaccttggggttgaaagaaataatatgtatacagcctttagactgcagtctagtgtatagtaaagattcaatatattagctattattactacagatatttggcctaaactttgtgtgccttatctgtaaggtataaactttgcaggattgttcgaggagtgaatatgtttgtatgtctactgaagcccggcacatatggacacaataatgacagccattaatttaataaacatgctacattactgattactgacagggtttcagttatctcttgcggaaaaaatttcctaaaacctagtggtttgaaacaatagcaatcagtacagtacctctcactctttctgcagtttaagagttcaggaagggctgggcctgcctggacacctctctgatttctcttgtgtagcctcaggagcctccctgggtgggctctgtactaaggcttccttacaatatggtagcttcttatcattgcttatatggtagctcagaatttcagtctcaagtgttttggctcacaaggcagaagctgaatcatcttttctaatggcctcattcagagggaggcaacacacccaccttttgatagagaaatgtcaaagttcaacaagaggatgtaggacagagctcccgtgatggccatctgtcaaaaatgcagtcttccacagagaggatctggagccagacacgcttaggaaaaaagctgtgagaggtggtcactctcacagaggcttccggctatctttttttttgtttctttttgagatggagcttcgctcttgttgcctaggctagagtgcaagagtgcaatgacacgatcttggctcactgcaacctccgcctctcaggttcaagcgattctcctgcctcagcctcccaaatagctggcattacaggcacctgccaccatgcccaggtaatttttgtatttttagtagagatggggtttcaccattttggccaggctagtctcaaactcctgacctcaggtgatctgcctgcctcggcctcccaaagtattgggattacgggtgtgagccaccgggcctggccagctttcagctatctttaagccaaagacagcagcaaggggagcaggatgtcaaggggaagcaggatttcctgctgttgcattattcgttttgacctcatctgaacacactgaacattcactgagcatgtgctcttgctggatgttacactaagcttcttacatggattattttatttaatcctcataacaagcctctggaggtatatatacagaatgctcaataagttaaataaactgcttaaggtcccctgctacagagggaaaggccaagttgaaatctggtacctccatccttccccatcaacctgggctgctgtgataggtacaatattttatgttctacctagatgattatgtgagtctatatttttacccactaagtatgctaatatgtttatttggattatttttaccaagttatcaaggtagaaagattgaaaaactaatcatttaattaaatcaaatatgtttcttccccaataatcctaaagaatggggaaaaggtaagaaaatctgattctctaaacccatttctttccactgtgtgcttatttcaaaggaggcaagacattttaatggctgggatattgtctttatttttgagctatgttttttcttttaatgcagtttattcaaattattataactcctgctttacggctagtaatctgttctgtggaaaagcaaactttatacatcacttattttttttctacttctgaaagctgtcatctagagcattaggaaatagctttgtggagatatcactgacatataaaaattgtttatatttaagatacacagcttgatgttctgatatatgtatacattgtacaatgatcaccacattccagctaattaacctatttgtcacgtctacatagttatcatttgtggggggtggtgagaagatttattttagatctagcctcttagcaaaattcaaatataagatatagtattgttaactatcattttcacgctgtacagtagatctctggaacttatttatcttgcatgactaagactttgtaccctttgaccaacatcactccattcctctcttcccccagcccctgggaaccaccatcctactctctgcttttatgagtttgactatttcagattccacatataagtgagatcatgcagtatttctttctgtgtctggcttatttcacttagcataatgacctccagctccgtctctttccctttaaaaaattcgataacctaagcaagtgtgtaccaatcttgatttcttctacagagacgtttactctgagagtatatgtaattttcattcttgatttatcttgcaggcatgataggaccccctgggccacaaggatttcctggtcttcctgggcttccaggagaagctggtattcctgggagacctgattctgctccaggaaaaccagggaagccaggatcacctggcttgcctggagcaccaggcctgcagggcctcccaggatcaagtggtaaagtactccttattcatatccattagcatttatgctgcttttgatatttgcagtgccactaagaaagcatagtttttaaaatattttaaaagttatatgatgtttcatgagctaagttggttgtcttttacaaacaaataaactgaagttggactttcacatccattaaagtatgtgcaatcatttggttaggagtttcagtgtaaatgatagaacttggtaaaataataccaattttttttaaatgtagttttaattttcatcagagttatatatgggcttggtttgtgactgcccggtgggtttattttgcccactgcccagggagagccgatttgtcgagacaggggaattgcaatagagaaagcgtttaacatacatagagctggctaaatggaagactggagttttattattactaaaataataaatgaaataaaaataaaaataaaaaagcctctctgaaaatttggaggctagggttttttaaagatagtttggcaggcagggggctggggatgagatcatgggggtgtggaaaatggtcctaacgtgttgaatccacttctgggtgggtgccacgggacccttgagtcatgagtcttgggtctaggtggagccatccagtcatcagaaacgccaaagtctgaaaagacatctcaaaaggccaatcttaggttttataatagtgatatcatttataggagtaattggggagattgcaaatcttgtgacctctggaataataatgctgctaatcatttaagtatacctacatcttagcagaatacaggcccttcttgttttgttttgttttgttttgttttgtttacctggtggctttttattagcattatgaaggtagtttagttttggggagggctattattatttaaactataagtaaattctttcaaagttagcttggcccacgctcagaaatggccaagggcagtttagaggctaaagacaaggtgaagttatttaggtcatatctccttcactgtcacaattttttcactgtgagaatttttgcaagggcactttcaggtttaagagtcaaactgttctacaaggcatggtatggataactcaaatcccccacaactccttctcctaatccttcctctccaagggcaatcatttcaacacatgtggctggatattttgttatttgcctctatactgacattcaatgtacttgtattgctatttctcaatttttccaattcagcattatcttttgactttcctttacggaagatgaatttagctttctttcaccaacccctcacccgacatgtgcacattttctactcccacaaactacaatacaattattgtcataattttggttccataaatattcagagtttacactgaatagttggttatataagggccattcaccagctgagccatataaagtataaattattgcttttccagaacatcttgtcaattgtcttgtttcctttgtctgtttgcttggttttcaatatacttataatttaacctcaaactgcccagaattatctaaatttcatcattatacactctaactcattaactattctattagtattagctctttgaataaatctctcctgcagctttttgagttgttcagattaggtcaggttgcattttttaatttgttgccagaatactgtcttgagatcttcctttaccaatatcctgagactttctttcctccatcctctctctttctctggggccctctatttcccatatattttttaatgctttactacctcattatatttcctgggaaaaagtgtaaataaaagggcaaagttgggagatcttgcttgtctgaaaatgccttaattctgctgtggactttgatttctagtttggctgagtataaaattttagttaggaaatctttctccctcaggattttgatggcattttctattgtttcctagcttccagtgttggctactgagaactcataacatttagatactttattttttggttttgaaatccattttcctttctggaagctcataggagctctttttttttgtttgtttttggggtcttaaattccacttgatttgccttagtgtgggtacatttgtactggcttgcacacagtcagtaagcagttttaatccagcatgtagctttcatgtcatgtcttttcttttcttttcttttcttttctttctttctttctttctttcttttttcttcctgagacagagtgttactcttgcccaggctggagtgcagtgatgcaatcttggttcactgcaacctctgcctccctggttcaagcgattcttctaccttagcctcctgagtagctgggatgacaggcacgtgccaccacacccagctaattttttgcattttttagtagagacagggtttcaccatgttggccaggctggtctcaaactcctgaccccaggtgatctgccccctttggcctcccaaagtgctgggattgtagatgtgagccaccgtgcctggccctatatccttcatttctgaaaatttttcttcaagtgtttctttgcattcaatcttagccaaaaggctgagaagagatcaagtgtcctttgaaaacgttgtctcctccattttttcccctcttttttctctttctgtactctatctatctgtcagaaaatcaatcctacatgtcttttttttttttttttaacctttactctattactctccagctgtttatttttctgtaacactttctgggagatttcctgaactctacattacaacccttcacctgaatttttaaatttctgctctcatgatctatttatatctatatctatatctatatctatatctatatctatatctatatctatatctgtttttcaattgctgtgttctcttttaatgtttccttttgtagcaggctgttcatgtttcagggatgcaatactctccctcatcttctgttttaattgtaaaataaattaaaatagcttgctgtgatgcgtgtttcttctaggtttttttggcggggatagtagggggtctattttctttccctgctgccaatttcaggaaggggatcttttggtctgtttttttagacaaatcatcctgttttggacctcactgttgttcttattccagaggtacagattcttgaaatttaggagacatttctggggtaaatcaggttctttctcagctttctaagcttcctgtttcaaattcagcttttttttttttttttaaggatctgccaagttcttttacttggttgttgctggttcctctccctttttccttgtcctgtgggtttatacttatttttatttatttatttattttatttatttacttatttatttattttgagatggagtctcattctgttgcccaggctggagtacagtggtgcgatctcagctcactgcaacctctgcctcccaggttcaagcgattctcctgccttggcctctcaagtagcggggattacaggcacgcaccaccgtggctggctaatttttgtgattttgcagagatggggggggttttaccatgttggccaggctggtctcaaactcctgacctcaagcaatccacccaccttggtctcccaaagtgctgggattacaggtgtgagccatcgcaccaggccagtttatgctttttttataatattcttttactctactgggatttggggaggatgccaaactgtttgcattttatctgtcgtctttaactgacatctctgaaattttatttctataagctctgcttttccattttcttcattagctaagaattgatcactgagtgggggaatatctttgccatacactgagtccatttttttgtttatttgttttgttttgttgtccattatcttgttttgcaacccattaatttaaggtagggctgagattagggttggctttatcaatggttatggtagcagaagcatgccataaccactgcatcatctatatgtgtgtatattcttatttcagacagaaagaatcctaggaaaacaagggcgcaaagaatggggttgggaaaggaagcacgtgggggaggatgtgagtgcaaaagtcacttattctatagaagacagtcagaaaaattatgtgattctctctgcccacccccttacctccttgacagtgatatactgtagtgttgggaaccccggaccacaaggaataaaaggcaaagttggtcccccaggaggaagaggcccaaaaggagaaaaaggcaagtaggcaccaaaggtagaatttctagaagacaactgtacatggatgatcgggggcatttctgagatgtgtaatgtggcatttcattcagatttgttactcaccttagtcacccactagagtactccattaagtgctatgtgattacaagtcactgaaaagtcaaagccttgtgtcttatatatttataaaggccttgtgtcttatatattataaaagtcaaagccttgtgtcttatatatttatatatatgtatgtatatatatatatatatatatggaacatttgcctgccatgaattttgtctgcaaatggtgactttgctcacaaggtcctcttgattccttgagagtggcagtgataggacagtattgatgtttgatttttgtgggacctatatttcccagactcatcaattgcctgtctctctgcttctccactctaaattgtttggagccgttttgggcaactgagtcaggtgggtgtgacagcatcaacacagatgaggagtctgactaccctgaagacatttgtttaagacaaaaagtcctgataattggaaaatgcattgtggtgaattatcaattataatattcaatgcaatcaaaatccttcttcatgtattattttgtctccttaattgtttagggtttgtgcactcaccaattaattttttcagtttttttttcaggaggaaccaaaggatgggcttttaaacttttaaaaataaaaaagttgaattatttttaacgtttcttcagtagaattggatatcagcttttccctagaatttgtcaggataaatttattaaggaacgaaaccctccatttgtttagaaatggtatgcccaccctacatcccatgcctaggcaccccatgtagtgccccatgccacacccagcccccacagcacgtgctctcaattgtctgcaagaagtgcatatcggactctttgttcttcatttatgctattggttttgtacagtaaagcccttattggggattttattcaggaaatatgacaaatctgccattgatcctctgtctaggaaatgaaggactctgtgcctgtgagcctggacccatgggcccccctggccctccaggacttcctgggaggcaggggagtaagggagacttggggctccctggctggcttggaacaaaaggtgacccaggacctcctggtgctgaaggacctccagggctaccagtgagtacctcttaccagtcatctttccagttaaaagagacatggtattagtctgttttcacactaccataaagatactacccaagactaggtaatttattaaggaaagaggtttaattgactcgcagttctgtatgggtggggaggcctcaggaaacttacaatcatggcagaaggggaagccggcatgtcttacacgacagcaggtgacagagagcatgaacagggaagagccccttataaaaccatcagatctcatgagaactcactcactattgtgagaacagcatgggggaaaccctccccatgatccagtcaccttctaccaggtccctccctcaacacatggggattatggcgattacaattcgagatgagatttgggtggggtcacaaagccaaaccatatcagacacgtagagataaaaatcgaggtgcctctttctaatttattgtgtgatatatgatttatgttttgaacctacaaacattatgctaatgcctgcaaaaacagtttatttactcatccattcatccatcgtttacttattcaactaattggtattgttaagtgcctgctatgttctaggccttgtttcaggtgctggggatacagcagggaccagagcccagtctctgccctcctagagcttcagagaggacacagaccatctaacagatcagcaagtaaatatccagtatgtcatgtggtgataaacgccatcaccatcgattgtagctggagagaagagagagaggggcagagcaggaaatgaagtcaaggaactggcaggaggttaggaagggctgcagagcatggggctttacagatgggtgaggtctgagcctttactctagactacatgaaacagccaggggagagttttaagaagagtgagacaatagttttaaatggatcactcactctggttgctctgtggagcatagaccatatggataagggacattggctgggagatgagctgggaggctgctgtgtaatcctggtgagatatgacagccaatgccttaatgtggtggtgctgggtgtggtgcaaggtggtcagattctggatatattttgaagacagagccaacatgttggctgttagtttggacataggatataaggaaaagagaagtaagggacagaaccagggttttttgtttgagccactggaagaaggcagttgccatgtactgagatgggaaggcgatggaaggagtgggcattgggtgaggaaagaaagcagtactgtttgagacatttcaagtttgagatgcctattatacagtcaagtcaagaagtcaagtaggcagtaggatgatattcaacttaaggattcagatgagaggtttgggctggggatataaatactggctttgtcagagtttacgtgatatcatgccagagagtggatgagatttacctcaaggtggttctcatttggtgaaagttacagatgaagcaggttgaggcaaagcctctcagctgtctgattgctcataatgcaagcactgcccactggggtactcccctggagactggagagagccctctgtcccctccttattaacaaggctcaatcctgggatggcctggaacttgaccatcaagccccaaaggacttttttccattttccccagaaaatctcatgaaaataaggttccaacccgagggccttaagtgaagttaatgattaaggtgtcccagcagtacccttgtcacatgtacaaagcccactggccacctctgctcaataggaagctaggtccttaatgcatgtatgtgcataagcatggttgcaattgttaagtagtttgcattcaacattttaccatagtcatttttgtgtgtgttggtacttaatcttcttagtgaagattttaatggctctaaaatatttttgcggcttcctgttgagttgctacttagggctaacatctttgagtgaggactgcttgtttatctagggttatcatggctaaggtttacttaattcagttgctctatggggctttcctttgtaggctggccacgtttctgattgtgtatctggtctgttgtgtatatgattctgtccatatggcttctctgcattaaattcattacattgtggtcatagtcagggaccagggtcataccatggggcactagggaaggaaagggtagagaagggagggaagggggaggagaaggggaagagagagaagaaaaggaagggaaagaaagaaaggaaaggaaggagggaagaaaagaagggaaaggaggaagggaaggacagacagaagagcatgaaagacggtgcagactatggggtgctctcgctcttgggggctctccatcctccctacatctcctctctctggagatggtctgcttgtctctggccctagcagccacagattggtaggaaagaagaaaacagaaaactaggcttaagttctttgcaattgtttgtataattgaaccaagtctttgcattcattgccttagcctgacggcgctccctaggatgggatttccggccaggatgctctagtgcaaggcactagggcctaggagcaagtggaccagcttcagatcccatctccgacatttgggagctctgcagtcttctaagttttacttgcagcatttataaaatggatataagaacaccatcttagaggcttgttggtaagaattcaattgagtcatgtgttttgcacactgtataaggtacataccagtgaattaaagtccaggaggctgcagagcgaaccaaaggtcgcaaactgtcacaggctgataacgtttggatgtgtgccccctccaaatctcatgttgaaatgtaatccccagtgtttgaggtggggcctggtgggaggtgttttggtcatgggggtggatccctcacgaatggcttagctccatccctttggtgatgaatgagttcttagttcttgctcagttagttcacaggagatctggttgttcaaaggagtctgggacctcctgctttcctctcttgctccctctctcaccatgtgatacactggcttcccacttcaccttccgccatgattggaagcttcctgagggcttaccagaagctgagcagatgctggtgccaggcttgtacagtctgcagaaccatgagccccttttctttacaaattacccggcctcaggtatttctttatagcgaagcaaaagtggactaatatatgggctatttctgacctgctggaatgtttggttgtgtcctcatggtgtttgtttttgagttattaatgtgaggtttatggcttctcctgagatattagaagtttatgaacacaaggttattgcgttcccactgctgctgtggctgcgggttgattccccccatgcctacccacctgttccccttggactggacaggcgccacccctgtaggcatctgcagttgatgtcccttatctagactgaacaactaggatatgcctggcagagaggaagtgttttttttgtttcgttttgcttttgtttttttttttggtggaatttcactcttgtcgcccaggctggagtgcaatggtgcaatctcagctcaccgcaacatctgcctcccgggttcaggcgattctgctgcctcagcctctcgagtagctgagactacaggcatgtaccaccacacccagctaattttgtatttttagtagagacagggtttcacctttttggtcaggctggtcttgaactcctgacctcaggtgatcttcccacttcagcctcccaaagtgctgggattacaggcatgagccaccgtgcccagcccggagaggagtttttgttgctgctgggcttccgttgttagagtaacacaagtgtttggtgatctcaggtcttaagattgtaaaaagtagctctctgtctgaagctgctgagaacctttgccccaggaatcgcttaggttacacatttatttcactagttaactgctgtattctcagtactcagagtaatgcctggttctttgtagttttcaaagaaaactacagtaatggttttagtaatgtttagtaacatttactaaacaatggtttagtaatggttcagtaatgttttcagtaaatgtttctttaatgaagtccagtaatagttttccttactagctcaaataagtctatgatctactctagtacttaaaattcgacacctacagagcattagagcaattcgtcatacatttgaagtctccaatgtgctgagtaatacactgctcagactcctgggatgggttcattcttccaaggtaccaaagtcttatttattaagcattccacttttttctctttctggaaagaaatttgtccaaatgctatgtgaacagttttctgtcctgataatttattcttcagaagggcattttctttatccatttcttgggcaggataccatatgacatacactttggccaggccccactgctacttatgactagcatatatagtaaaaataagaataaaagaaaacccaacctacattagtactttatgatttctaattctttctaatatattgatttatactaagaaatttgttctacccacctttttgatggttcacagacattgctacaaacaggatgctatactagagtgatatcagagatattgagttatgtgtggacatactttttttctctgcatgaaatggcttccaaccctgttgtccatttgagtttttatgtctgttgtttgcatttttggcttcctcttcactgttactgcctgatgattgctgatgccactgtgcccatctccactggtaccctcctcccctctatagctctcagcttataaattagtacagccagttaaaaaaagatagttaagcttgcttgaacacattgttagattgtgtgaaaataagacaagaccaggtgtggtggcttactcctgtagcctcaacactttcagaggcagcaggatcccttaaggctaggagtttgagaccagcctgggcaatacagcaagaccccatctctacacacaaaaaagtaaaatccaattagccaggcatggtggcatgcacctgcagttctagctaactgagaggctgaggtaggaggattgcttgagcccagaggtttaaggctgcagtgagttatgattgtgccactgcactgcagcctgggggatgaagtgagaccccgtctcaaaaaaagaaaataaataaaaagaaaatacgacaaggtagtggcatctgtgtgagcaaagcaactggcttgctcagtcatttttacctccctccaatttctttgctgtggttttttgactattgatatcactaggtaagtaaccttgggctctgtatagtgtttctataatggtatttgaaatggtgcttggccaccctaatatactgacaataggttcatatatatatattttttgacacagagtcttgctctgtcacccaggctggagtacagtggcacgatctcagctcactgcaacctccacctcctgggttcaagtgattcttatgcctcagcctcccaagtagctatgactacaggtgtgcaccatcacatccagctaatttttgtatttttagtagggacggggtttcaccatgttggccaggctagtctcgaactcttggcctcaagtgatccgccttccttggcctctcaaaatgctgggattatagatgtgagccactgcacccagccaggttcccataattttgacatggtttgatattcagtaatatgtaacacttaaaaagtatgactcaaattattcagatttgagcaatgttgtggttaagagagcatgagcatgtcagccaaaattagctatttacctgttatacagaataaatatattagcttcagaaaaggttcttaattcctcttctcctgctcatcaactttccttagcaggacgtcacttccatgcctttttcatcacaaacttatccctaaatctctaccttcagctctggtggcagctcttgtagttatcccactctcttctttcctctccatttcacattacaaagcccatgataattacaaaaattagttataaattttaatttgaggtagttgactcacaagacgttgcacagtcataaagttcccatgtatgcttccccagcttccccagtgatacatacacataaccatatttacataaccacagtacactgtcaaaaccaggaaatggtcattgatacagtcctcttaactcaggtacagaccttattcagatttcaccagcttttacatttgacatgtagttcaagagccccagctttgcaagacaggactaccttggaaggcagggaagtggaagagaccaagaatgccaagctagaatctttaacaagagatttaggagggaagaagagagagattcaatatgtacagatgtaactgttgatccatcacaattaacctaatttgtttctcttatttttcaccaagggaaagcatggtgcctctggaccacctggcaacaaaggggcgaagggtgacatggttgtatcaagagttaaaggtgagcataatcaatcacttaactccctgccattttatgaatgatgtatggaccctcctcttgcagtaatttcccctgtgaccatagatcaattctatacaatttaggatggttgagattacttaaaaaaatacttcctgcccttcataaggttgtatgaatgttgagccaaatcccctgtctcttatttgaaaacataaatattcctttagccacacattcacatcttcattatagtgaacttgagtttggctcaagccctcctttggcttggctggtgtttattcaccacattacagtattctatattagtcaataatattttcattgtaaatgaaagaagcccagcttgaaatcgtttttttaagtaatttattgacctaaacaaaatgtgaaatattaaaaggtagtgttttttattagtaagagttccccagggacagaactaataggatatatgtgtatatgaaaaggagtttattaaggagaattgactcatatgatctcaaggtgaaaccccactacaggctgtctgcaagctgaggagcaaggaagccagtagtggctcagccccaaaagtagtggctttcctacttttgagtccaaaagcctcaaaagtagggaagccaacagtgtggccctcagtctgtggctgaaggcacaagagccctggcaaaccactgatgtaagtttaagagtccaaaggccgaagaacctggagactgatgtccaagggcaggaagcattcagcacaggagaaagatgaaagccagaagactcagcaagccagcttatcccaccttcttccacctgctttgttccagctgtgctggcagctaattggatggtgcccacccacattgggagtaggtcttcctgtcgcagtccactgactcaaatgttaatctcctctggcaacaccctcacagacacacccaacaacaaccctttaccagctatgtaggcatccttcattccaatcaagttgacacttaatattaaccatcacaggttggcattgggacaaccagatcccggcctccagtggcatcaagaggctctccctgcatctttcatctcacattgtaccatctatattttctcccatcagactgattttcatacccccaggcagctccaagttcttacatccagagatgaagagagccctgctttgtcagctccaaatagaaaaataatttcagaaaggactgattagcttagggcaagtacccaaccgcagaccattccccctttcccatggccagggatagagtgctgtgcttggcatcacaggtaggggaagattctgtgattggcaccttcacacaccagctccttgctggaatgggaaaaggagcttttcccaagtaaagagattcaatggttctagcaattgtcattctcccctctggctttggcatgttttatgtgacttgagcaattgagatacacaggaaactaccaacccagaatcaaggtcattttctttattttttgtcctctctatcctactttaccctctgctgataagagcttgaatatcttttgacctctatttccagggcacaaaggagaaagaggtcctgatgggcccccaggatttccagggcagccaggatcacatggtcgggatggacatgctggagaaaaaggggatccaggacctccagtatgtagaattcttctcttgctatagaatttcactttcttatatggtcatacaaacaactatttcccctttctctatttgccaagctgaaattcagtaaaatatcaacatactataaatcagagtcacttttggcaccctgacatggaaagatgattgttttaagaggtatagcatcattggacatggtctaaaatcctcttggcagttcagtcctagcaggactttcggtccttggtctttatatcattctcgtggtgttcattttcttctgagaaacttgtatcctagaagggccccactgattttaggtgtattcagttgactctgtggggtggaggatggagctcgggtcccgatgtttagcatcaattctgtttcctggagaagatgcacatgggggaagtagtgagcatgaaagggtgaactcgtgcaaacccacagagtcaaggcgttggctgatggaaaatctcactgataaaggatgttgctgcatttttcagacatgcgttgggtggataccatgtgtaggtaatggtaattaaggtcataaaagaagaggatgagatgatccgatgcttaggaacttaaaatatcttaaatatgtgcagtatttctgaatgcttacaatatcacagaaaccagactagatggtttcctcaaaacagtcttctgaaaagcaatacctttccaattttacagtaagaaaatggaggcttagcatctgatattcaaggctacccatctgtcaaataggcaaaataggagtgaaaacttgtctgtcttatttcaaagtgcatgctatttctaccaacctgtgctgcctgccatatataatgggaagccactgagagtgttgcaacagggaaagaccatgtcctgattctacaggaaacccttcagacagaatccaagtgaacaagagagagaagcctggaaattggcttagatggtgtttatagctttctgacctttctcctgatcacaagtatgtgaatgatctctgctttaggcttggtaatctctgcttaattcattcttcctctcaaggaactacttagaaatcactgtcactgagtggatattgtcataatgtactcatctaattgtgaaaaagcagcgtctatatagatcaaactaggagacgaatttcaacgttcgctgaggtcttcctagattcgttgaaacaatccagatccataagactgttgtagaccacatttgagaccaggccatgtagaaggataaaaggtcactcaaaatgccagcaggacagtgtcagatattccttgcatttgagagtgcttgcagctgttcagtcaggtggggtgcaagaagggatgagacccacatatggtgggcatggaggcagccctgacttgaaagcctcattccccatgggagctgttatccactgcacagcttttgagaaccccaccagggattgccagtgagggaatccttgatgcaggctccccacagttcttccagaccagatgcaaattttgcaactggggattgattttactataagcagtactgcctaggaaggtagttgacaatctaatttttatcagaggaacagaaccagacagttaaccaaaagtcaaattgtcatgcaagaggagaaaggacttgctaggcttttacccacaggggtggaggatgatggagtctagctatgtatcttgtcaagagaatacataagaatgtatttgatttgtaatcccaccacctcccttgatctacttatttctatattctatgacatatgatattagagaatggtttgacataaatctcttattctgtatttaaggcatatcacacacattgtttccagtatttgaggcttaacacacatgcttatattatatgtatgtatataaattgtaaaatgtgtatattggccaggcgcggtggctgacgcctgtaatccctgcactttgggaggctgaggcaggtggaggtcaggggtttgagaccagcctggccaacatggcgaaactcagtctctactaaaaatacaaaaattagccaggtgagctggtgggtgcctgtaatcccagctactcaggaggctgaggcaggagaatcgcttgaacctgggaggtggaggctgcagtgaaccgagatagcaccactgcacaccagcctgggtgacagagagagactccatttctatatatatatatttaaaatattaagaagtatctaagttatttattttaaacttacatttgcttaagagtaactgtctcctgaaattatggacttttgcgtgtgtttctgtaacctacaatgactgctttgagttcatggacattcagtggttggtaattgactcatgacataacattcccagggggatcatgaagatgcgaccccaggtggtaaaggatttcctggacctctgggccccccaggcaaagcaggacctgtggggcccccaggactgggatttcctggtccaccaggagagcgaggccacccaggagttccaggccacccaggtgtgaggggccctgatggcttgaagggtcagaaaggtaattttaaaaaaattttatttatttcaatagctttggggtacaagtgtttatttttcttatgtggaagaattatatagtggtgaattctgagattttagtgtacctgtcacccgagtagtgtacattttacctaacgtgtagatttttgtatccctagacccctttcctccctcctccttctttttttttttctcagtattcaagtgtttttctttttctttttctttaattttactttaagttctgggatacatatgtagaatgagcaggtttgttacataggtatacatgtgccatggtggtttgctgcatctatcaacccatcatctaggttttaagccccacatgcattaaggtatttgtcctaatgctctccttccccttacccctgaccccctgacaggtctcgatattatgtgatgttcccctcccctgtgtccatgtgttctcattgttcaactcccacttatgagcgagaacatgcggtgtttggttttctgttcctgtgttagtgtgctgagattgatagcttccagcttcatccacatccctacaaaagaaaatgttctcattctttttttatggctgcatagtataccatggtgtatatatgccacattttctttgtccagtctatcattgatgggcatttggtttggttccaagtctttgctatggtaaatagtactgcaataaacatatgtttacatgtgtctttatagtagaatgatttataatcctttgggtatatacctagtaatgggattgctgggtcaaatggtatttttgattctagatccttgaggaatcaccacactgtcttccatcatggttgaactaatttacactcccaccaacagtgtaaaagtgttcctatttctccatatcctctccagcatctgttgtttcctgactttttaataatctctactctaactgccgtgagatggtatctcattgtggttttgatttgcatttctctaatgaccactgatgaaaagctttttttcatgtttgttggccacataaatatcttcttttgagaagaaggatatctgttcatatccttcacccactttttgaaggggttggttttttcttgtaaatttgtttaagttccttgtatattctggatattagacttttgtcagatgggtagattgcataaattttctcccattctgtaggttgcttgttcactctgatgacagtttcttttgctgcacagaagctctttagtttgattagatcccatttgtcaatnnnnnnnnnnnnnnnnnnnncatagatcgtatatcctatatgtctccgctcgtgcatactcatcagtactcatcgttcgtcgttgcaagctatatcagatgcagtatgcatatcactctcgtcactcgtgtctctcgtgttagcaactacagtctcgcatctcgatatgagagttctctgtctactccgtcatctaacgttgttctgcggtcgtggtctatgacacactgactaacgcggcctaactaccatggaggtcagactgttcgtcagacggttagatgtatagcacgtcttctagtcatgtaggagtctcgctcactccgctgacagtgcgactgtgcgacagaacggcatgagcgtgatcacatcacatttgactattaggctcgatctgcaatcgcctctggtctggcaatcatgaagtcttcgcccatgcctatgtcctgaatgatattgcctaggtcctcttctagcgcatttatggttttgggtcttacatataagtcattaatccatcttgggataaatatagtataagatgtaaggaaggggtccagtttctgcttctgcatatggctagccagttttcccaacaccattaattaaatagggactcctttccccatagcttgtttttatcaggtttgtcaaaaagcagatggttgtagatgtgtagtgttatttctgaggtctctgttctgttccattggcctgtatatctgctttggtaccagtaccatgctgttttggttactgtagacttgtagtatagtttgaagtcaggtagcttgatccctccagctttgttctttttgcttaggatggtcttggctatatgggctcttttttggttccatgtgaaatttaaagtaatttttttttctaattctgtgaagaaagtcaatgatagcttgatgggaatagtactgaagctataaattactttgggcagtatggccattttcatgatattgattcttcctatccaagagtgtataatgtttttccatttgtttgtgtcctctcttatttctttgagcagtagtttgtagttctcccttgaagaggtccttcatattccttgtaagttgtattcctaggtatttttttctctttgtagcaattgtgaatgggagttcactcatgatttggctctctgcttgcctattgttgatgtataggaatggttgtgaattttgcacattgattttgtatcctgagactttgctgaagttgcttagcttaaggagtttttgggctgagacgatgggattttctaaatatacaatcatgtcatctgcaaacagagacaatttgacttcctctcttcctgtttgaatgctctttatttctttctgttgcctgattgccttggccagaacttccaatactatgttgaataggagtggtgagagagggcatccttgtcttgtgctggttttcaaagggaatgcttccagcttttgcaaattcagtatgatattgcctatgggtttgtcataaatagctcttgttattttgagatatgttccatcaataactagtttattgagagttttttcatgaagagatattgaattttattgaaggccttttctgtctctgttaaaataatcatgtggtttttgtcagtggttctgtttatgtgatgaattatgtttattgatttgcatatgttgaaccagccttgcatcccagacttgatcgtggtggatatgctttttgatgtgctgctggattccgtttgccagtattttattgagggtttttgcattaaggttcatcagggatattagcttgaaaatttttgttgttgtgtctctgccaggttttggtatcaggatgatgctggcctcataaaatgagtaagggaggagttcttatttttctattgtttggaatagtttcagaagaaatggtaccagctcctctttgtagctctggtaaacttcggctgtgaatccatctggtcgtgggctttttttggttggtaggctcactacctcattggttactgcctcaatttcagaacttgttattggtctatttgaataaccaaataaaccagatttgaattcttcctggtttagtcttggggcatcctcccttttctgaatctctgaagtccattatatcactcttatgcctttgcatactcatcacttacctcccactcgtaagtgagaacatacagtttttggttttccactcctgtgttacttcatttataattatggcctccagctccatctaagttgctgcaaaagccattgttttgttccttttaatggctgagtagtattccatgttttttgtataccacattttctttatccactcattagtcaacaggcacttagattggtgccacatctttgcaattgtgaattgtgctgctataaacatacatgtgcaagtgtctttttcatataatgacttctcttcctttgggtagatacccagtagtgggattgctgggtcgcatggtggatctacttttatctctttagggaatctccacacttgttttctacagaggttgtactaatttacatttccatcagcattgtataagtgttcccttttctccacatccatgccaatatctattgttttttgtctttaaataatggccattttttgcaggagtaaggcaatatctcattgcagttttaattggcatttccctaatgattagtgatgttgagtattttttcacatgcttgttgtccatttgtttatcttactttgagaaatgtctattcatgtccttttcccactttttaatgggattatttgtttttttcttggtgttttgtttgagttctttgtagattccgcataccggccctttgtcggatgcatagtttgcaaatagcttctcccattctgtgggtttctgtttactctacttatttattttttttgttgtgcagaggccttttagtttaactgggtcccatttatgtatttagtttttgttgcatttgcttttggggtcttattcatgaattctttgctgaggccaatatctatatgagtttttccaatgttgtcttatagaattttgatagtttcaggtcttatatttaagtctttgaaccatcttcagttgatttttgtataaggtgagagataggaatccggttttattcttctaatacatgtagcttggcagttttcccagcatcatttattaaatagggtgtccaccccccaattttttgtttttgtatgctttgttaaagatcagttagctgtagatatttggctttgtttctggattctctgtgctgttccattggtgtatgtgcctacttttacaacagtaccatgctgttttggtaactaaagccttgtagtataatttgaagttcagtaatgtgatgtctccagatttgttcttttttgcttaggattgctttgtctattcaggctcttttttggttcaatacaaaattcaggattgttttttctaattctatgaaaaatgatgtgcatattttgatgggaattccactgaatctgtagattacttttgaagtgtggtcattttcacattatcaattatcccaatccataaacactggatgcatttccatttgtgtcatctatgatttctttcaacagtgttttgtagttctcctttttgagaactttcacctccttggttaagtatatttttagttattttattttagttttcacagctgttgtaaaaggaattgagttattaatttgattctcaacttgattgttgttggtgtatagcaatgctactgatttatgtacaatgattttgtaacctgagactttactgaatttgtttatcatatctaagagtatttttgaagaatccttaggattttgtaagtgtacaatcatattatcggcaaacagtgatagtttgacttcctcttttctaattttgatgctgtttatttatttctcttacctaattgctctggctagtacttccagaactatgttgaataggagtggtgaaagtgggcatccttctcttgttcctgttctcagggggaatgctttcaacttttttccattccatatgatgttatctgtgggtttgtcatacatagttattattatttgaggtaggtcccatctatgccttgtttgttgagattttttgtcataaaggaatgctggattttgtcgaatgctttttctgcatctattgatcatgtggtttttgtttttaattatgtttatgtgatggatcacatttattgacttgcatatattaaaccatccctacatccctgggatgaaaaccacttgatcatgatgaattctctttttgatatgctgttcaattcatttagtattttgttgaggatttttgcatctatgttcatcaaggaaattggtctgtagtttgtgtgtgtgtgtgtgtatcttttcctgtgttggtatcaggatgatactagcttaatagaatgatttagggaggatgccttctttatcaatcttttggaacagtttcagtaggatttgtaccaattcttttctctcagtgtctaagtagaatttagctgtgaatccatctgattctgggtttgttttcttgggaatttaaaaattactgattcaatctcactgcttgttattggtttgtttgaggtttctatttcttcctgatataatctagtagggttttatgtttccaggaatttgtccatttcctctagatttcctagtttgtgtacataaaggtatccatagtagtcttgaatggtcttttgtatttctgtggtgttggttgtaatgaccccagtttcggttctaattgagcttatttggatcttctctcttcttttcttgtttaatctagctaatggtctattgattttgtttattttttcaaggaaacggctttttaactagctttttattcattaatttttcatatttttttggtttgcatttcatttggttcagtctgatctttgttatttcttcttctagctctaagtttagtatgcttttgtttttctagttccttgaggtgtgactttaggttgtcaatgtgtgctttttcagactttttgatgtaggcagttagcactataagctttcctcttagcactgcttttgctgtattccagatgttttgaaaacttgtgtcaatattatcattcaattcaaataatttttaaatgtccatcctgatttcattgttaacccagatatcattcaggagcagattatttaatttccatgtatttgtataattttgagggttccttttggagttgatttctaattttattccactgtggtctgagaagatacttgatacaatttcagttttaaaaaatttattgagacttattttgtggcctgtcatatggtctatcttggagaatgttccatgcttctgagaagaatgtatatcctgcagatcttgggtagaatgttctgtaaatgtctgttaagttaatttgctctagtgtgtcacttacatccattgtttctctgttgacgttctgtcatgaagatctgtctagtgctgtcagtggtgtattgaagtctcccactattattgttttgctgtctatctcatttcttaggtctagtagtaattgttttttgaatctaaaagctccagtgtttggtgcatataaatttatgattgtagtatcttcttgttgatcgttttatcattacatagtgaccatctttgtctttttgttattactattgttattttgaagtttgttttttctgatacaagaatagctatccctgctgcctttggtttctatctgcatggaatacattttcctacccctttatcttgagtttatatgagtatttctgtgttagcctcttaaagacagcagatatttggattgtgttgtttttgtccattttgccatcccgtatctttgaagtggagcatttacactcaacatgaatattgagatgtgaggtattgttctcttcatcatgttaattgttacccagatagttgtcttttcattgtgttattgtattataggccgtgtgagttctaaagtttcaagaggttctattttggtgcatatcaggcttttgtttcaaggtttagaactccttttagcatttatttatttatttatttatttattattatactttaagttttagggtacatgtgcacaatgtgcaggttagttacatatgtatacatgtgacatgctgctgtgctgcacccactaactcgtcatctagcattaggtataactcctaatgctatcctcccccctcccccctccccccaccccacaacagtccccagagtgtgatgttccccttcctgtgtctatgtgttctcattgttcaattcccacctatgagtgagaatatgtggtgtttggttttttgttcttgcgatagtttactgagaatgatgatttccagtttcatccatgtccctacaaaggacatgcactcattgttttttatggctgcatagtattccatggtgtatatgtgccacattttcttaatccagtctatcattgttggacatttgggttggttccaagtctttgctattgtgaataatgccgcaataaacatacgtgtgcatgtgtctttaaagcagcatgatttataatcctttgggtatatacccagtaatgggatggctggttcaaatggtatttctagttctagatccctgaggaatcgccacactgacttccacaatggttgaactagtttacagtcccaccaacagtgtaaaagtgttcctatttctccacatcctctccagcacttgttgtttcctgactttttaatgattgccattctaactggtgtgagatggtatctcattgtggttttgatttgcatttctctgatggccagtgatggtgagcattttttcattgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttctttttctgtgcagaagctctttagtttaattagatcccatttgtcaattttgtcttttgttgccattgcttttggtgttttagacatgaagtccttgcccatgcctatgtcctgaatggttatgcctaggttttcttctagggtttttatggttttaggtctaatgtttaagtctttaatccgtcttgaattgatttttgtataaggtgtaaggaagggatctggtttcagctttctacgtatggctagccagttttcccagcaccatttattaaatagggaatcctttccctattgcttgtttttctcaggtttgtcaaagaccagatagttgtagatatgcggcgttatttctgagggctctgttctgttccattgatctatatctctgttttggtaccagtaccatgctgttttggttactgtagccttgtagtatagtttgaagtcaggtagtgtgatgcctccggctttgttcttttggcttaggattgacttggcgatgccggctcttttttggttccatatgaactttaaagtagtttttttccaattctgtgaagaaagtcattggtagcttgatggggatggcattgaatctgtaaattgccttgggcagtatggccattttcacgatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttacttatcagcttaaggagattttgggctgagacaatggggttttctagatatacaatcatgtcgtctgcaaacagggacaatttgacttcctcttttcccaattgaataccctttatttccttctcctgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaaagttgttgaattttgtcaaaggccttttctgcatctattgagataatcatgtggtttttgtctttggttctgtttatatgctggattacatttattgattcgcgtatattgaaccagccttgcatcccaggggtgaagcccacttgatcatggtggataagctttttgatgtgctgctggattcggtttgccagtattttttgaggatttttgcatcaatgttcatcaaggatattggtctaaaattctcttttttggttgtgtctctgcctggctttggtatcaggatgatgctgacctcataaaaatgagttagggaggattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgtttgttagttttccttctaacagtaccctcagctgcaggtctgttggagtactgggccctgtgaggtgtcagtctgcccctgctggggggtgcctcccagttaggctgctcgtgggtcaggggtcagggacccacttgaggaggcagtctgcctgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttctgggctgctttgtttacctaatcaagcctgggcaatggcgggcgcccctcccccagcctcgctgccgccttgcagtttgatctcagactgctgtgctagcaatcagcctggcgtaggaccctccgagccaggtgcgggatgtgatctcctggtgcgccgttttttaagcccgtcggaaaagcgcagtattcgggtgggagtggcccgattttccaggtgccctctgtcacccctttctttgactaggaaagggaactccctgaccccttgcacttcccaagtgaggcaatgcctcgccctgcttcggctcgtgcacggtgcgcgcacccactgacctgcacccactgtctggcactccctagtgagatgaacccggtacctcagatggaaatgcagaaatcacccgtcttctgcgtcgggcgcgctgggagctgtagactggagctgttcctattcggccatcttcccttttagcatttcttgtagtgcatgttttgtagtgaaaaatttcctcagcatttgcttgtctgaaaatgactttatttctccttcatttatgaaatttagttttgtggaatacgaaattcttggccgacagttgttctgtttaaggaggttgaagataggatgccaatcccttttggcttgtaaggtttctgctgagaagtctgctataagtctgataggttttcatttataagttacctgatgcatttgtctcactgctcttagaattcttgccttcattttgaatttagatagtctgataactatatggcttggtgaaggtctttttgcaatgaatttcccaggagttctttaagcttcttggctttggatatctagatctgtagccaggccatggaagttttcctcaataactgcctcaaattagttcttttttcttttccctcaggaatgccaattagtcttaggtttggctgttttactaataccatatgtcttagagtctttgttcatttttttcttatttttgtctgattgggttaattcaaaagccttgtctttgagctctgaaattctttttgttctagtctattgttaaaactttccactgcattttgtaattccctcagtatgtttttcatttgtcaaagttcggattagtttttcttgatgatatctgtctagagaatttttttgttcatatcctgaattgctttttaaatttatttatgatgttttcacccagaaaggtaattttgaatatttctgtggcagaatgtcacataaaatcatggaagctaaaatgagtctcttctgggcaaaattattatagctatggcataatagctacataaaatttgatccaggcactgttcaaaccttgtaccttgttaaacaaataaaagcattacaacacaatatttaaagtaaatccttaagatgctaaaatatctttgttgttttatttgacataccaaaattgcttttccttcatttctcagtatgaactcatacaatctgactatattaaaattacatatatgtatatatattatatacacatactcaaagtatagaattatttttatagtcttttgagataatactatatattttaatttttaaaaactagtatctcatttaaactatcattgtccatgaaaaaccatttgttggcattctagtgagaaaaaagaaggtattttaaatatattttacagttatgtgaatttcaaacaataaaatgactttcaggattatagctgaaaactcttaagaaggtggcaaaaaaggtttaagtttttttcttttgtaacatgtattatatatatatcttgaactacattgctagttgtgaagttttagaacaaagtaatatcctttgttcttgttttgataacagaaaggcaagcaagtatcttggtatttgataaggtataaattcatggtctagaacccaacaaaatctgatgtcatttttattcatctgatatatcttagatctgagagcatataaagaaatgcactatgaggtattattcctaatataaaagagaaaaattccattttaggatacaggaactgagagggaactgagaggctcaaacttgggtgttttattggtgatatctatctctctagaaaatttttcattcagaccctcaactgcttattaactttctttaaacatttctttaacatgggggatgatgctactagattgtgaagtcattagaaaaatgagacaatatacttgaagcaccaaccctcaataagtggtagctattcacatttagcccagcctcttcatttgcacaatttctccatgttcatagtaagagtcagattttctgaactcagcattggacacctgctgctattttatgatttatcgagacttctcattctattgtgttagatatgcatgtaatagatctccattacattattattattatctactacccatgtagttcatctccattacatttttatcatctacattgcttttatagattattgaaacttatactttttataatcaatatatttcttttcttacgtttataactcttctgacagttgaaattcagatttcaggaaaaatctaaaaattctgtatgaaagcagcttaagtgatctaatgatacttgggagtcttctttttctttgacttctgcatatactatacagaaaaatatcttgaggaagttgtcattgagacagactcacattgcactgggctatcagttatgtgaatgccgcttttcttttctcattgcaggtgacacaatttcttgcaacgtaacctaccctgggaggcatggccctccaggttttgatggacctccaggtattatcaatgagaagttactgtcttatatacttcccagagtaaaaaaaaaaaaaccagccagacagataaaccaagagtgaatcctcagactagttaggacatttctgaagttttgagggaccatggataggggaaaacagcatttgtagtaatttgtagttgggcctctagtctgctggtttgagaacactccagatgggcttttcaaatctttgtacaataaaatttaccttgatttgctcacatatcagttaaaatgtctgtcccttgaaagttttttttttttttttgagacggagtctcactttgtctcccgggctggagtgtagtggtgtgatctcagctcactgcaacctctgcttcccaggttcaatgattcttccgcctcagtcttccaagtagctgggactacaggtacccgccaccgtgcccggctaatttttgtgtttttagtagagacagggtttcaccatattggttaggctggtcttgaactcctgaccttgtgatccgcccacctcggcctcccaaagtgctgggattacaggtgtgagccaccgcacccagcctgaaagttttaaaactgtatcttctttcctttcctgtgcctcaagagtgaatcatgatcacttgtttattgattgtaagttttactttccaagagaaccaacatttgatcagaaacatttgaaaaaaatgcccaaatatctctgtccttgtttgcacattcatgcaacagcttcatttgaatcaatcacttatttttagatgaattaaatccaaaatctatctaagatattttgcctaactcttctttgtttctttagagttccctacccgttcattactagtatgaataatgactgactgttactctctctaccatcaaattttatgacaataatgtgtaaataatctcaaaatctcagtgggctacagcaaacacttattttctatcttatgggtctgcaggttggttgggtttagctgatctaagatggtctctgttggcttagagtgtagctccaagttaggtttggggttgcaacatgcatctcattgcaaggccaggcttttctcatgtgattgcagaaatgcaagagggccagctcagctcacaggctccctccacacctctgattggatcatgggcattcatttcctattgcccaaaacaagtcacatgaccaagccctgggtaaaagggcagggaattacactccgcccaccacaaggcaatggcaagagtgcggaaatataattccgtatcagcggagtggagaattgcaggttgacggattgaacgttcatttttacttttactggtcatgggtggataaaaaaaagtttgatttctttcagcagctgtaacttcgagagaagtgaatactcacattttaatttgacagttgtgcctccattgaagtttatgatttataagttattttagctgagataactccttgtagaaaatcacagaaggtttaaaatagattctctaggccgggtgcggtggctcatgcctgtaatctcagcactttgggaggccgaggtgggtggatcacgaggtcaggagatgagaccatcctggctaacacggtgaaaccctgtctctactaaaaacataaaaaattagccaggcgtggtggcgggcgcctgcaatcccagccacttgggaggctgaggcaggagaatggcgtgaacccaggaggcagagcttgcagtgagccgagactgcgtcactgcactccagccttggtgacaaagcaagactctgtctcaaaaaaaaaaaaaaaaaaaattctctattactttttgcaagtgctttttgcctatacttcatttaagggcaaattcagtaagatgcagggaaatagattttggtctttaatctgatcctttcttgtcaaggtagacactggccaccacctctttacccctacaagggcagacaatggttgcatagtcgtgtttcagacctagcatgggaagataccaaaaaaagtcacctgaatggtggtacaagttccaaaggctttcaggaagaatccttcacaggatggcttctgagaaagtgccttaacaaaatcactcctagaaaacatttatttggagcatatgacttacaatatatttttgtaaatcgggataggcaacatccttacttccataaagtagaaatattctaaaaggacttaacatagacttaaagaaaatcatctcattttgttcacattagattttgttttattgagtctgtgttttgtttttattattgtttaggtccgaagggatttccaggtccccaaggtgcccctgggctgagtggttcagatgggcataaaggcagacctggcacaccaggaacagcggaaataccaggtccacctggtcagtgaggttttttttttttttttttttttttctgctttgggaatatctatcaggaactttttaacatttctaccgatggataatttcattgaggaaatggtccagggatccctagataatagggaaatggtgtttcttgatagacccttagctatattgtgataactttcagattataattttataagttgccaaggctccttacaccttgaagcataagttgtgggctattatttgtctattatgttgttgaaactactcagtccagccagaatgtttgccagagaaggaaagcaattagggaaacatcattggcttataggaaacacaaagttgcagtttctctctctacaaaaggtggcaaaacaacattactgttaaactgctcttaattttagtaagtacccctgtgtttttaagaaaagtatttttatcaaagtaagtcttatatgtattggttctatacttgcacatgttatcattaaaaatttttttttgttgttaaataggttttcgtggtgacatgggagatccgggttttggaggtgaaaaggggtcctcccctgttgggcccccaggccctcccggctcaccaggagtgaatggtcagaaaggaatcccgggagaccctgcatttggtcacctgggacccccgggaaagaggggtctttcaggagtgccagggataaaaggacccagaggtgatccgggatgtccaggggctgaaggtatgagggctttgctgtccttttggtgcatagagctggctcagttttggaacaggtcactgaagaacgtttagattattttgctttaggcatgtagaatataaacagtttacccaagtgttttccctcatttggggtgctggttacatttcaaataacctgaatctctagccttgcctttgcactttattgattgttttcaaatgcagggcagctcactgtggttcattcaactcaatttgattccgcagctagtatgttggtgctgcaaaggccaagagcagggactgtgtaacctgtctggggctgttgccaggtggaaggtaggcaggcctgattgtgagaggaagagtggcttagaggctggagctgtgagctggcatctgggaacactctatgggagagccgggtatgagctgagcctagaggacaagctgtcttcgcacaagagacagggtagagggaccttcattccatttggggtggcaggcagggcatcaaacgcaagagaggaagatggcctggacactgattcatatccttttctgaaatcagtagggatccttcaggatccccagtggagtttttcaggttttaatgtacttaaaaataaccaagtgggggtggggcagctcattaaaattattgtcttcaggaccccagtctgaggaattctgattcattatttctggggtggggccccacattctgaacttcagtgggcctcttgggtgatggtgatcaagatgtgaaccacagatcagatgtttacaaagaacattctggttcttttctaaaagtcggtgggccagtgtttattaggcatccactagagtacattagcacaggacacgtggaggagaggaggagaattagcaccctcaaggagcttgcatggaagtttgtaaataaaaagattcatattgaaagaaacaattaattggaaagtaacaggtgaaacataatgtaagtcaataaaaataatgacccagtaatccgactatctcacttgtgaaaatatatctaagggaagtgttcaatggaagaaggttatagatatgaaaatgcccttgtagtattatccacagcagaggaataattggaaagaacaaagacagacacacacacacacatacacacacactctatctctcaaaggaataccatccagccattagcaatttaaatcatatttgtaaagactgcaacaaactggaaaacatttgcagattaatatgcaatctgaagcgctccaacaactgaatttgcactgattactatttttaaatgtaaacatatgaaccaaaatgtaaagaaaacataggaaaacaaagtagatttttgggttagggtgtggaattatgggggatgttctttcctgaagattatgaccctgtctttctagtgagtagaaatttgagaatacaagtgatgaaatctctcataaaatgcaaattcatacagtgcaaactgggtttgtaaatattgtagagatttgatgtaaagcctgatgcaaagttagaggttaattaaaattaggaagaaccaagtggtttcttatttgcataggcaactgcagtccacataaccttatcaagtaactcacttagcaatgcgttgtttctctgttcataaggaactcattacatctatgataagaaaatccactcaaagacttaacccatttgaacactgattcaggatgaaaatgttcacctccagtattgatatgcgtgaacaattcatcatgggccatctgtatagttttttgtcatgaatgtcatggatgtattgtatcatttcagggccagctggcattcctggattcctaggtctcaaaggtcccaaaggcagagagggacatgctgggtttccaggtgtcccaggtccacctggccattcctgtgaaagaggtgctccagggataccagggcaaccgggactccctgggtatccaggtagcccaggtaagtgtcaagaactgtgaagggtctggggcttaccctacttacaattaaataagctccccttttactcttttatggatgctgccagaagcaagagtcctgagtcagagacaaaggacttcgttactcatgagtttcatgttggtttgcatcacttcccccatgtcacccaagtcttatggggcaatgtagtgggctagttggccacacacacagtgggttgcattacatgagaggagccctgagccaaggaaccactgctttatagcaacctgtgagaaagcctgcttttcctattgaggaaagtgctatatcatttatcaagggtgcttgctgcaaacacaagcttgagaagtttcccaggtaaagagcattaggatcttgcattcttggcatacccaggaagacgtaggaacacaagagacccctggagtgtctcctaatacaaggtgcagggaggctgccttagtccattcgcactgctctaccaaataccttaaactaggcaatttataaacaacagaaatttatttcttatggctcaggaggctgggaagtccaagatcaagctgccagcagatttggtgtgccttccttgtgtcctcacaggcagatggggcaaacagctcttttgcacctctttaataaggtcaccaatcttattcatgagggctctgcccttatgacttaatcacctccccaagtgttcaccttttaatactatcacattggtgattaactttcaacatatgaattttggagggacacattcagaacatagcaggggctattttcaatatgatcttcatttcactattcacattgtttactctgtcatttcaatcccattgcttttatccaaatgcagtaatatacgcacttgaaaaattaaaaccagattgaggcaaaactttccgctacagccatatttctagcaccaataatgctagacaccggctctgacttcttctcggctgtagagcttcaggaaaaacctggaaagttttcttctattagtttccctccaccaagaggaaatacaaatacatgtttgttttttctttttgttttctgttaaaaatattttttataatctacattcatccctactgggaaacatttactcaaatgatctgcccttctatttatggcatctagaaaaatatattcttagattgatggaaagttgctactgttattttagccaacaaatattgctttactgttgtttaacgcattgtttaagctactgtatatttttcctgctgtgtgtgaagccagtgttcagccttcacacactgtggtcactgtggtttgtcttaggtgctccaggtgggaaaggacagccgggagatgtggggcctcccgggccagctggaatgaaaggcctccccggactcccaggacggcctggggcacatggtcccccaggcctcccaggaatcccaggtccctttggagatgatgggctacctggtcctccaggtccaaagggtaggtagtgctttttccatgatgtcctcccatcttagaaacatgaaatccactgccaagtgaagactggacagatgaccacacaaaaagagttaactgttagtctggctttgtccttcccttaatgatgcctcccttgctcttgtcctctgtatcgttatttccagtggcgaaatgtttctgtaccggtcaatgggaaaaggggtttgtaggtgttagggccacagaattcatgaagactgggtagcacggtaaactcctagggtcgggaagggtgcattttcattttggagggggtccccactctcatccctaccccctgttaggggattaggactcagacacatcagggcccacacttcaggtctgtaggtaggaaactgaggatggggcggcagagcatggaatttttattttatttttttattttattattattattttttttaggagacagaggcttgctctgtagcccaggctagagggcagtggcaggatcatagctcactgcagccttgaactcctgggctcaagtgatcctcctacctcagcctcctgagaggcatgtgccaccacgcctaattttttttttttttaggagacaggatctcgctattttagccaggctgatcttgaaatcctggcctcaaagatcctcctgccttggtctccctagtgccaggattgcaggtctgagtcaccgtgcccaactgagcccagctactaagtgcagtgaggttggcaattgtttactttgaatacaaactcagcgttaggcaggagtttgcatctgtagatgaactacgaggaacacaatatataagaatcatactagcctgtaaaatgttttcctagggccaggcacagtggctcacacctataatcccagcactttgggaggctgaggcgggtggatcacttgaggctaggagtttgagaccagcctggccaacatggtgaaactccgtctctactaaaaatacaaaaattagccaagggcggtggctcccgcctgtaatcccagctactcgggaggctgaggaaggagaattgcttgaacttgggaggcagaggttgcaatgagccgagatcgtgccactgcacttcagcctgggtgacagagtgagactctgtccacctcccacccctgaaaaaataaataacaaataaaatattttcctaaaactttatgctctcatttcaccaggaccccgggggctgcctggtttcccaggttttcccggagaaagaggaaagcctggtgcagagggatgtcctggcgcaaagggagaacctggagagaagggcatgtctggccttcctggagaccggggactgagaggggccaaaggtaaataaaatacagccatgcaacatgcatttgtttctggtatttgatccaaacctagaaatgtgatctctgaaaaataaaataggacttgtctgaagcttggattcctcctccttttagttctatggtatttgttttagaattttaaacaaaattcattttctttacctcttaatcttattacatatagatggcaaatgaattgctctattaattgaaaaagaattaacaagtggttcttaatgcactgatttatagcttctaggtttcaaagaactttctcaccttttgggaaagggggctcttgttctccaacctctgtttcagttagaacagaagttggtaagctcttcctgtaaaaagcctgataataacaatttcaggctttgcagaccatctggtctctgtcacaacgactcaagtctgcttttgtagcatgaaagcagacatagacaacacagaaacaaacataaaatacaattttcagtaagatggtatttatggatactaaggtttgaatttcatataattttcacaccatgaaatattaccttgtttttgagttttacccctcaaccatttcacagtgtaaaaatcattcgcatctcatgtgctgtacagaaactggcagcaggaaggatttggcccatgggctgcagtttgccaacttctcaactaccatgagtccactttcatctgggccacgagtagagtttccccaagcttcatttgaaaaaaaaagttttctggccaggtgtggtggctcacgcctgtaatcccagcactttgggaggccgagacgggcagatcatgaggtcaggagatcgagaccatcctggtaacacggcgaaaccctgtctctactaaaactacaaaaaattagccaggtgtggtggtgggcacctgtagtcccagctactcgggaggctgaggcaggagaatggtgtgaacctgggaggtggagcttgcagtgagcagagatcatgccactgcactccagcctgggtgacagagtgagattctgtctccaaaaaaaaaaaaaaaaaaaaagaaaaagaaaaaaatgttttctttactatgaaaaataagttttgagaccaatggtttaaatattatgtccccatccctgttaaatatttactcctactccttagtcctgtggctctaatgggtgaaggtagtatttcctttccagtgttgagaaaaaatgcttgacaattttcagacccaaggatttttgcccttaaggccttttgggcaagtagcctcatattgaattaaaattaccttttcttcttagttgattgattctaccacaattttttgttttactagcttgtaaattatttatgtggaatcaaagaatcaaagagtcactctttgctagcttagataagtgatgtttgctgtgctattatgctactatacaattatcccactaaaaattaaaatttggactaacgccagtgatgggctagtaaactagttttttgaaattaaaaaaaaaaagcaccgtggtttatagtgtttgctgagtgtcatggcataaatactcctgccacggctgatttaaagttagcaatggtttaacaactggcttgcagggttcttgaattgtggtaactggcactcgtcaagctggtaggagcccacgcctgcacattgctacagctggccagtgtttgcaaaatcaggcagaagtacggtatgcccttcctacctttcagaagtcagtgtgaggggtaccacattgagataagtgtctgttcttttaatataaggaaagtaagagaggatggctaggaggagatatggaactggaaatatgagatgggcaaatccaaattttatagaacaaagcgacattttttgtagactggaacttttcaaatctgtcttaacctcagtgaagaccccgaccagtttggttgaatttggcaaacattcagtgagcactcctggcacaccagactctgtggctggacaaatggggtcaggaacgtaaaagatgactgaccttcctttaggaaatcagccaacaatggtgacattttgtgatctacataaatagagcttcgtaggttaagtgggaatttgcgatttgggagtgaaatgtagtaatggataaattatgtgtgtgatgttcctgttcattttgttcttgcataattaatatccataggagccataggacctcccggagatgaaggagaaatggctatcatttcacaaaagggaacacctggggaacctggacctcctggagatgatggattcccaggagaaagaggtaaacacttaagagtttttaaccatatcaaataagttgacatttttacagatcacatttgttaggcaactttccccaataacactgagattagaaaagacttttttttttttgagatggagttttgctcttgtcgcccaggctggagtgcagtggcaccatctcagctcactgcaacctctgcctcccgggttcaagcgattctcctgcctcagcctcccgagtagctggaattacaggcgcatgccaccacgcctggctaatttttgtatttttagtaaagatgggggtttcaccatgttggccaggctggtctcaaactcctgacctcaggtgatccacccgcctcggcctcccaaaatgctggattacaggcgtgaaccactgtgagaaaaggccattttttttagatataaataaacacaaataaaccttgtggtacattttttgcttctccatgctaaaatttagctgaagttcctgtgtactcctagatttggatattctaaactgggatcaacctgagctatacataaaatactggtttcaggtttggtagttggttttaaagtgaatagcgcaatgactgttcaagtcattgtgaccagtgcctctcaaacttcagagcacattaatcacctggagagcttgttaaaatgcagattctgattcagcagctctggggcagccaggtatcctgcctttctaacagacaccccaatgcccatgctaatggtccacagaaacattgcagagcgaggatttttgacaaccccatttgtgtgctcctccaaggtcagacttagtctgcatgaggtgctcatcttggcttctctcagctagttgttagagggcaaatattttaacttttctgggtaagtgcttcttcatttgtaaaataagcagcggaggcaaataatcctgtgtgctccttcccacctctgatagtccttagatattcccaggcagcttctttcatcaatgaggtcactgaagccagaaatgatcaggaagcggcttgggacagcaatcagaatcctcaatacctttggctttatctcctaaaagtaggaccaggtccctcagcttaactattacctagctcaaaatttcagcagagacctgtaacacttccaacttcatcaggtgataaaggaactcccgggatgcaagggagaagaggagagccgggaagatacggaccacctggatttcacagaggggaacctggtgagaaaggtcagccagggcctcctggacccccaggccctccaggctcaactggtctaagagggttcattggttttccaggacttccaggtgaccaggtaaggggctactgctttgtgggggaagagacaataaaacctttctgttcttaggatgtccgtaaggagctataatttgccagcgtatataccattgccctttcactggcttttagaatgtaaggtgtagctcaaggagaaaatagagccttctagaaggccacgatgaaactgacatttctgaccagtgctcctgcctggttcccctaacatagagtcatataatcgctatctcccagcctggtttaaaccacccatgaagacttgcctcatgaccactggtttactggaatgaaagtcgtcctgaaaaatcacccaaatcctgtctttaaagtcttccagtttcagatatcacagattttgctttcaatatatttcgtcttcacaaccatgagtaaaataccctttcagaatccaggaggtacaatacatgtagttgccaacattatacttctggaaaacacgtaactcactatccatcttttggaatgaaatggatttgtaaagtctttcatatgctgtgatttataatactattttatttagtatcaacttgtttatttgtaatttaaaattcaaattagtaacacaattactgtttcacaaccaagtgtagagaatgggatgctaccagttgcgactgagaactctaattctggagaagctatatcaactttgaaaaactagatacatgtagtgggaggcttgcatgcatttaaactttcgttaccactgcagattacaaaaaccaaattagttacagaaaattacaactggatcgtgttgtgcatgtgccatttgtatttgaaatctgattaaggccttttgtttcattaaactgtcagggtgagccaggttctccaggtccccctggattttcaggaattgatggagcaagaggacctaaaggtatggtttggagatacagaagccatctgtcaaatgcatagtcccgaatgtttataacattgtaaacaagtgccttttacatgataagcaaagtgtatcaaagaaactgcaacacccaaggggctcttgttagacagtcaaacactcaagatccaaatattctacagttgtcactcagatccaagggtatcagatagaaaacagcatgcctgcaggctcttcgtgtcttcctcctctgtgagagtcccagcagcagtccatggagtgactgcagcccctcaagtaacagctcagttgcaaggagaacagatccatgtcagtgggccgtgcccactttggcttagaaaccctatgtcccgcaggagccagtatcttttctaaggacttcataagtacagcttttagagtcccagttaggacatagaggctaaagccatgactttccagcaggtgctaagagttcacttaagaagtcccaagatagatgtaatttacaattgggttttttattattattattatttttttactatagcaaaatatttttttcctaaagggccagatcataacaattttcagcttgttgggccatatggtctcagtcacaactattcaactgtgttgttatagtgtgaaagcagccataggctatatgtaaacaaaggagtgtggctgttttccaatagaactttatttgcaaaattggctgcaggctagatttggccccacgggccttagtttaccttgtgtcaaaaacagtgctgcattgtaacacacctaacattctagtgaaagagaggcttcattaaccctttattcagacaaacaagtaaacaaacaaagagcaggatatcttagttgcaatgtttgcataaaacctttaatagttttactatcttggtataccattgggttaatatttttctttaaatctactttaaaatgatttacctttttaaccttagccttagcgtaactagctgtaaattcacaggttaacatgcagttatcctttattttgatataagttaaaagaaatttaaaatataaaatactaattaatgaatgacctacaatcctctgccttactactttgagagacactctataaataatatactaaatgctataacaaacatgacctgtgtgggcttatttcttcagaaagaataatatagatcccttcttgggaaatggttacaaatggaaaaagttttatatttgattttgatattttataactttggggttcagaagtcactccttttctgcttacctatacatttattagtctctttaccattctttcacagtaaaaacctacctcttctcacttccttcatgcttgtattgggccatgcttaaaaggaattgaaatgcactcaaaatacctggagtcaaagatgtctcatggatcccacagataggagacatagttctgccaaagctaaaggaaccctagcccttagtcaatccatggtttctcactttttcccatggtctattttttcacttacctgtctaccaactggcttcatctctgtctacacagtatcttttctggatatttctggatatgttgggttgtactccaatatgttctacatcaggacagctcatgataatgcttttggtttctgccccagtagccaaggacttcaaattctcactttcttattccatcttctcaaggaaagacttgtttgacctggaatgggccagaatcccacccctcaagcaattggccattattatgagtaaaatcagataggagaaagacttccacaaggtgctggtggaactcctttagaaaggagtgtaaatgggcagttactataagatacatctaacttacctctgtaattctcttgaaaccccatctattttcttgcctttcctcccactccattttgagtcctccacttcaaactggctcccaaccataatgtaggtccttgtgtctggaagcattatggagtgaccagtagctttgtgggactgtgggagtcatggcctacagtggcttttgaatgtgccatctcttgtcatcaatgcagtatgcctttgtgattttctttttgcaaggacactgagttgagctgccttataaaagagcttgaaatatgattgcagcagtgaaaacagttacaatttttgattttggtttctaaaacataaggatatagccactcaatgccaaataatttcttaaatagaaacctaaagttgaaaattttttcaggacttaaaaactcaaacttatcaatacctggagatccttatgattgtgatgtattctaaaaccgtgtgtgtgtgtgtgtgtgtgtgtgtgtgtgtggtatgtaaattgcatcttgcatctatatttctatttgttcttatttagaataaaagtatttaaaaacactctcctaaaatatctgaagataagctatacaaataccataaacgttactgtcacctgtatgagaccaaattaaattgtctaaagtaatgtcacatgcattttatccctttcaggaaacaaaggtgaccctgccagtcactttggtccacctggtccaaagggtgagccaggtagccctggatgtccaggtatagctgcatatttttcttactaaaacaaaaaaagtagtttagtttgaaaagcagaacaattacttctagctggcaatgatcgtatcaatattttcttacccctttgtgcattaaggtatagataaaacgggttatatataaacacttccatagcatttcttgcctggcctagaagaacaccagggttacatactagggattcacaatcatttttccatcatggctcatgtgaccgatgatgttgacacaataataaactccccaggcatgcccatattttggcaaactcaaaaatgaatattgcaaacaattaaaatctggaccattttgcaccctctatcatttaaaatgatgcattcgcaataaccactcacaatgactacagctgcaggttgtcattccagctctttctttctactgagaaaagcacatgccagtgtaagtggtgcgccattgttgagccatcattgaatctattttaatttactaaaaatcaaaccaaatcaagcaaacataaacctcatcaccaacaagaaatctaagtcattttaaacagtattttgcttctcaataataatttaacatggaatccttcagaatggattgtgatgcaccattgagttcttgtgacagttgaggccacaactggctacattagatgacccacagcagaaggggggtgccagtgttatgcacagctccatgctttacagggaaagggaaaccatttgagttcaagccgacagaacaggacccctagaggggaaagcagccttaggacagaatgttctattggtttaactcatatatgtttacatttcagaaaatgttgcagatattaattggtactccctttctggaccctatagaaatgcaccaatatttaaaatatgcatatcgcttgacttaggaattctcttaggaatttatctggagtcagtaatcagacaagtgtacaaagatgcatgcccaggaatatgcgttgtttgaatggaacaaatgtccattcacagatgcctggttaaataagttatatcccagggcactcagccaatagtggtcaggttagaaaccaggtttgtgtttagatgggtaccttgtaaattaaaacacctcatatcaataattttgtgcattatcttaaaattccatctggcaatagctgtgtttcatttcatacaacagaaagaatattagatattttctgagcagaactatatgagaaattttattttctttgtttttatactgtaagattgctaaaatggaagtctaacaaaaacaagttaatacagtggcacaaactacctttcccaccttctttgctatgggtctttcacctctgacatgaacaaatatatttagatatatatatatgtacatatatatctaaatatatatatgtatatatgtttagatagtatatatgtatatatgtatacatatatacatatatactatctaaatatatctaaatatctaaatatatacatatacacatataaatatatacatatatacatatatacatatatacatatacatatacatacatatatatactatctaaatatatatacatatatatgtatatatatgtgtatatatatatgtgtatatatatatatgtgtatatatatatatgtgtatatatatatatatatatgtattttttttttttgagatggagtcttgctgtttcacccaggctggagtggagtggcacaatcttggctcactgcaacctccaccttctgggttcaagcaattctcccaccttagcctcccaagtagctgggactacaggtgtgcaccaccacaccagctgatttttgtatttttggtagagacagagttttgtcatgttggctaggctggtctcaaactcctggcctcaagtgatctgcctgccttggcttcccaaactgcttggattacaggtgtgaggcactgtgcccggcctagacatagtataatattttaactgaactgtataactgaagtatacatttgatagggaaaatagttttgaggtcagcattatgggagttcatgacaaatatcaaagtgagaagcctcagaagggaaaaatcggtggctcaaagtcaacctccattattacttcacctgtggtcttgggtaagctgagagtatcttctctgagcgtagttgcctcacctgtaaactggccctatgcatactgcaggattgtcctgaggatcaaatgaaagaaactgaaactgaaaataactatacaaaataaaatgcaatgatcatcattgtcatcatcaccatcatcagtcagcaaaacatgaagacattttcccatacttactggtatttttatgtaaaccccaaagataggaagatttcataagctcagggtagtccaaaatgggggcctgtgatgttacctagtattttaacttaaaaatcataaacctgagtgattttacacttaggctgactttttcagaaagtttgccttggccaaatttgcctgttctcctgtggttaccaccatttaaattggcccctttcccatatgccatggcctcagcttagaaattttaaattgtattatatgttattcactagcacagagtttacttaatacactatttccattgactggagaaggcttcattgaacttgaatgagcatcatgagaaggcatgaatctgcagctggtcttgggattatatgtgattatcctgggttcagtcctacctactctgcactctattcagagagaaaatatagtgcaaattaactcagaagttctgttcttaacacaaccccacaaaattcaggagacaagtttttatttttaatatttcagtgttttcatttgtagatgagaataatgctactttactgtaggaatgttttcaggataaataagataatacatagtgagactaatagatgttaaattcaatcagggaacaggtacagactaacaaaagcttgtttcctgtgtgctataataaatgatgactatagcccccccagcatggtttgtaaatacagagacatatattttatgtgcagattcaaccagtgattttcagcacacactattggtttatcccataaacgtgcattaaactcatacattgtaaataaacacacggggaaatagtcatcctctttagtaatcaaagaaatgtaatttcaagtgtctgaaatatcattttatctttaataaattagcaagaaaagaggccaaaaaactaaaatgtcctcagtaagaacacggcatgctcttggagctgtgggtgggttccatatggtggtgtgagtcagtgcagcacttactccaaactactggcaacctgtatcaagaaccaaatgttgaatggtctgttctagaaaactagagaagaactgaattgtgctctgcagcaagtcactgtcataagaaaaggactgctttaaatttttagaaattgaagagacctatccattagatgttatgggtgattctgggatggaacgtggtgtggagaaaccaactgtgaaggacattaaggggataattggggggattcaagtatgggatgagtgtttgagggtattaagaattgctattaattttcttggctgcgaaatgttattttggcaatgtagaaaaacgttcttatttttcagacttcttacctcctgaagtatttagggatggaattacactacggtgtgatgtactttaaaatacttcagcatttaaaatgcatttgaaaataccaaaatatcatgctatttatccagaaattctactcctaggaatttttcctaaggaaacaatttaataggagaaacaaaattgacaagagatataaagagcattatggataacggcagagttagagataacttaaatggccaatagtaaaataaattgaattagttaatttaattaagattgactcaaaaagctactggccattcatttaaaaatgataattaggaaaaccaatataaacttggaaaattacttatgatacaacactaattttaaaaaccagaatataaaattgtgggtattatctgtacatgtatgtacatatgaagaattgtgttaagctggtgggattatgggcattttgttatcagtttttccttaacgttattttcctttccaatagaaactatttaaaactaaaaaagtaaggatagaaaagaatagggtgggctgaacttggtgattttaaagattcactgtctcaaacggcaactctgatgtttgatctttccttctttagggcattttggagcatccggagagcagggcttgcctggtattcaagggcccagaggatcacctggaaggccagggccacctggctcctctggaccaccagggtgcccaggtaccttgaaaggaaatctggagacttcctgagcactcttgtgtctcagagtgtttcagaaaccaccagtctttaattagacctaaattcagatatggctctgccatttcccagacctgtgactttggataggtcacttaagctcacctatgcctcacctataagctagtgggtttcactgagtgacttggagtagattaagacagcacctgtaaagtgcctagcatggcaccagacacaaaggaatggtcagacagatagcaactcctttctttttagtttttattcttttagagagagagggcctcactctattaacaaggctggagtgtggtggcacaatcatagctcactgtagcctcaaactcccgacctcagggaggctgtctcagcctcccaaagtgccgggattacaggcatgagccactgtgtctggcccagatagcagctcctttctagccctttgcatttctcctgccattcaggatgctgttttgtttgtttgtttgtttgttttcccctcctttagacctaaggcagatgtcacacttacagcacagtgttttaatggatactattcctgccaattcagaaaaaaagagaaagtttcaaactatagttggcaacttcatttatttggaaatgtattttctcctcctgaatttaaatgtatttttctccctagagttaagatgtataggaagaaaaagtaattagacagtgttctccgttacccatatattaagaacatagatgacttttgcagtgaatgtaattcatttattatctggccatctgcaaaacttccctgtcatcctcaggtgatcacgggatgcctgggctgaggggacagccaggagaaatgggagaccctgggccaagaggcctccagggggatccagggataccaggtcctccgggaataaaaggtaagtcaaaatgaagcccatcccacaagaaagatgcagcccaatgagggcaaattgatggtgtttttttcctgtaccagtgagtgaccctgctcttggttataccactcttttccgtaggtgccattagcatcttcctactcttccttagccagggctgcaggtagtgcccatccagtcagctgacctgccttctaccagggagaatggtagtgctaccattttctttctttctttctttctttctttctttctttctttctttctttctttctttctttctttctttctttctctctctctctctctttctttctttctttctttctttctttctttctttctttctttctttctttctttctttctttcccttcctttccttccttcccttccttccttccttccttccttccttccttccttccttccttccttcctcctcccttccttccttctctctctctctctctgtctttctttcttttttccttttctttccttttcttttttctttttttttgatggtgtcttgctctgtcacccaggctggagtacagtgacgcgttctcagctcactgcaacctccacctcccaggttcaagcaattctcctgcctcagcctcctaagtagctgggattacaggtgcacatcaccatgcctggctaatttttgtattttttagtggagacggggtttcaccatgttggccaggctggtctcaaactcctgacctcaaatgatccacccgcctcggcctcctgaagtgctaggatgtgagcgcccggttgctaccatcttatttctgaaggcatttagccaaatgatttttatgatgttcaggcccattattcatgtattcccttcacctatggttaagctcctactatcctagattctgtgctagatgctgggtgtacagttttgaagaaaatagacctgcttcctgccctcatggagctgacagtatggcaggagagaaagacattaataatatatgtggaaatgaatatatatttactgatcatgataagtggaagagaaaacaataaggtgctacagatatagaataattagtgttcatcatcttttttcgatcaagaataattttttctgggttgaatttcttggtctgtaaaggcaatagtggactggttataaaagtctggttataatataatataatacaatacaatataatataaaatacttgtcattaataaatctttatgccctcacattcatccatggtatcaacccctcttcagtccatttcttccactttagaaaaagtacttttttggccgggtggctcacacctgtaatcccagagttttgggaggctgacgtgggcggatcacttgaggtcagtagttcgagaccagcctggccaacatggtgaaacgccatctctactaaaaatataaaagttagctctgtggtggtgcatgcctgtaatcccatctactctggaggctgaggcaggagaattgcttgaacctggaaggtggaggttgcagtgagccaatatcgtgccactgcgctccagcctaggcaacagagtaagactccatctcaaaaaaaaaaaaaaagaaaaagtattttttctatgggtatttttgaacatatctttagcataacacttacgttgtatcacatttgtttggaggtttttctcatcaaacagagtatgattttttaaaaagcaaggacatttcatatacccttgagacccagtcaataacaagtatattggttggtggtatgaatgaatggacaaataggagaatgaatatctgagctagtagatatgaggttgcagtccttatctgaaccaacagctgatggttccagcttacttggtagagtcttgtaaccaggtttcctctatttcttcttcctttctccttccacctgcctttgctcattgactcatacgtatacgaaatcctggtaaaataaaaagtccctcctttcagaaggtactgagttggaaaccccttcttctgggattaatccttttactgttttgaaaattcaaatacgattttcccacactttgccctcttcactcattggatagctttgaaataattctaattttccagaagtggtagtgtggtaggtattacttggtgcaagtctgtggagacaggagccatttatgttgaagagttggtatactcatgtattttcacacaatcacataacttgataggaaaagttcccttcacaagacatctttgtactgttctccgtcttcattgacacttttagtaatatgaattccagcaattcatgataaatttaggatttcaggcaaatgatcattctgttattttgaaagtttctgtggtgattgtggccatttcctgtctctgaccatctctacagccttcatggcgtattctttgacacttttttgtgtccggaagacagttggtaaagaaccaaaagaaaacatttgtcatcattaaccactcccactttttcctaccctccacttcttcctaccctcccagtttagtaacacagcaaggatttttaagtgtcttggtggcttaaaaacatacacccaatttggtcaaaatggcagggctcatgccactgttgttgatctttctttcccttgaatttgtttgcatttatcacataacttcagtatggcatgctattacaaaactaatagctggccgacgtggtggctaatgcctgtaatcacagcactgtgggaggctgaggcaggcggatcagctgaggtcaggagttcgagaccagcctggccaacatatagcgaaaccccatctgtactaaaaaaatacaaaaattaggtgagcgtgatggcgggtgcctgtagtcccagctacttgggaagctgaggcagaagaattgctagaacccaggaggtggaggttgcagtgaactgagattgcaccactgaactccagcctgggtgacagagcaagactctgtctcaagcaaaacaaaacaaaacaaaactaatagctaataaatttgatccataacaaaatcaccccaaaattaatctccaatcacatcataattccgtgctatgaaatagtgtgttaaaaagagaaggtgaggaaatgaacatattacttggcatgttcataccacctacagacagatgttgcagtggtgctccatcaccatatagtgacactgtttcacttcaaacagctcagagaacaactggtctttaaaaaccacaacacaaaacaaaacagtgaaatacattctgaaaagttaaaacatctgcagtataaattcattgttgcagcttatcatgctgatataaaaatgaaccacactccagcagaaacactttgaactgagaaactaaatatttgcagtatgttctaactaagtcaaggggactgattatcttgtttgaacaaaccagctgctgaactcaaagctgtttgctctgctagaacaggccatatggattttgcatcctgcttgtgttcaatcagatttaaactttaacttaaacatatgctaaaaatggcttgattccagctaccattgactttcttcacataattacaaaaaactactttaaatttcaaatggaaccaaaaaagagcctgtatagccaagacaatcctaaacaaaaagaataaagccagaggcatcaggctacctgatttcaaactatagtacaaggctacagtaaccataacagcatggtactggtaccaaaacagatatcttgaccaatggaacaaaacagagacctcagaaataactccacacatctacaaacatctgatcttccacaaacctgacaaaaacaagcaatggggaaagggttccctatttaataaatggtgttggaaaaactggctagccatattcagaatactgaaaccggaccccttccttacaccttatacaaaaattaactcaagacggattaaacacttaaacataagacctaaaactgtaaaaaccctagaagaaaacctagacagtaccattcaggacataggcatgggcaaagacttcatgcctaaaacacctaaagcagtggcaacaaaaggcaaaattgacaaatgggatctaattaaactaaagagcttctgcacagcaaagaaactatcatcagagtgaacaggcaacctacagaatgggagaaaatttttgcaatctatccatctgacaatctacaaggaattcaaacaaatttacaagaaagaaacaaccccatcaaaaagtgggcgaaggatataaacagacacttctcaaaaagacatttatgcggccaacaaacatatgaaaataaaagctcatcatcagtggtcattagagaaatgcaaatcaaaaccacaatgagataccatctcattgccagttagaatggagatcattaaaaagtcaggaaacaacagttgctggagaggatgtggagaaataggaatgcttttacactgttggtgggagtgtaaattagttcaactgttgtggaagacagtgtggcgattcctcaaggatctagaaccagaaattccatttgacccagtgatcccattactgggtttatacccaaatgattgtaaatcattctgctataaagacctatgcaaatgtatgtttattgcagcactattcacaatagcaaagacttggaaccaacccaaatgcccatcaatgatagactggataaagaaaatgtggcacatgtacaccatggaatactatgcagccataaaaaaaggatgagtgcatgtcctttgcagggacatggatgaagctgaaaaccatcattctcagcaaactaacacaggaacagaaaaccaaacaccacatgttctcactcataagtgggagctaaacaatgagaacacatggacatagggagaggaatatcacacactggggcctgtcagtgggtgagaggctaggggagggatagcattaggagaaatacctaatacagatgtcgggttgatgggtgcagcaaaccaccatggcacatgtatacctatgtaaaaaacctgcacattctgtacatgtatcccagaacttaaagtgtcatcatcatcatcataaaatggcttgattcctagactttaagtacaaatgccctttaaaaggagaacacccagttcctagttggaaagtaatataagattgaaataatgaaaacctaaagaatattacctgtagcatgacaagaactggaaagaatatggattttgtatccatatttactggtagcaagtaaaatgtttcataagaaaaaagaatctggaaatggctttcctcagaaaagagatgccatgtcccttagagctatgaacatcatggaaatattctccccccgctttttttactagattactctcctcctgcccttcccccacagcacttaccacactggatgtaattgcctgtttgttctgtcaagtcagggacagacttgtcccgcatcgtcttgacagcacctgccaggaggtacatttggggcagactctgtgcattaggaaaccatatcttacacccttagtgggcactcacatatttgctgatacaaaaaatatttaaatcttatttcagaatctttgttaataagaatcttccaggtttttcaaccattacttatagtcacaaagatctctcttcccatcagctttgaagttagggtgagcagctgtcccgttttgcctgggcctgagtgggtatttcaggatgtagaaatttcagtgctaaaaccaggaagaagtcgcaggcaaacagggacacgttggtcaccctatgtgttaaaagtatgagcccatataaaagctcttgggtgtgtcgagtaatgttttcaggctttagaacaaaatacagcctgagagtgggaatgcagtcataaagagttcgctggctaacaaagatgggagccacaattccagctggattggaggttacattcactgactagagaaagagcacccagcctgaaagtgcagtgtgctgcagccttaaatgatggttgtttagcaggaggatgaccagagaggtgaataaaaattcctcattacccagaaatgtgctttgttagcctaattgcctctcatctgcactgtatatattttatgcatgaacaactttctgatttagagatgggattgataaaaagctttcagtaaaaaggaaaaattacccttacaaccctactcagatgtagctgcattcaatttagaacgataacattgggtcagataagggtcggccagttcaacaatggcgagaggctgggaccgtgacaacctaggatctggatgtgttgatgtgacaatggagagctggcagaagcagagacattccaccccagccaagtccccaagccatcaatcttggtgactaaagctggagatcaaaacatgtggaaatagtgaagtggtccccccgaaaatttatcatttcagatagattgcaataaatacccagatttggcagataaagaaggtctgtgtgttcttttggtgcaaacttgaaacgttggctcataaaataggaaagaggattggagaataaactaagccagaactgtaaaaagtggttaggaataagagatttggggaaaataaagatgcattcccattttttttttttttttggtgcacgagaatatggctcatttgaaccaatctaaatcctagatcttaaaagaataatgactgtctgtttcaagtactgatgataaatagaatggaagcaactaactgtgccagcttctaataagaatacacagaggacttgcttaaaatgaatagacaataattagcacttgaattatttatatgcaaactgatacctctaacttctgtaaattatatttgtcctataaatctattaaagaaagatatggcatacaaataaaaattctaccctgctcctttttgtagctttctccctcatccaccttgttccatattttttcattcagtcactcaacaaacatttattgaacacatccataggacctagtcttgaactcctatttacccttgagcaggggagacagtcacccaaagacatgattgtttcacagtgtggggtggacatcaacaatcaagggggtcctatatcatgggggtaggtgaggggcaccttctgtgttcaaccttataagctgatggtatttttatcccaaatttgagagatgtgaccctacactaagtaaacaggctggctgtgcaccgagaggctctatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacatcacactctggggactgttgtggggtggggggagggaggagggatagcattgggagatatacctaatgctagatgacgagttagtgggtgcagcacaccagcatggcacatgtatacatatgtaactaacctgcacattgtgcacatgtaccctaaaacttaaagtataataaataaattaattaattaattaattaaaaaaaaaaaagaacagctactgggtggaagatctactgatgagataggaagttttccaggcttgaccagaggctgggaagaagcttcagtgctcgtagccatcagtgggacaggacttgtgagaaggcacccagcagatggctcagtgccctggagatgctcgataaatattccttacctgctttcttccttgcctctcctcctccaactttaccaagggccatcaagaagtgtcatttgaaaaggctctcgttcagacaacttcaacacaactcaacatacgttgataaaaaaccttaaaaaaaattttccactggaagtgtttagtgacaacttcagtcaagccaggctggtggacggctctttggagaactaaacagaaggttctgagagaaggcacaggcatcagtggggtaatgtctgtttacacagacgggagttttcagtgatcatcgcaaaataaacttaggttctgcagaaaggcatcagaatggttgtgaaagaagtgactgcaaagcaatagctggagccacactcgccatgcaggcctgagcatcgcagggcaagcatttgccagcatgccacaggcgccatgcgtcctctcgtctgactgcatctccatgagtagatcctgaagaaaccagagcctgcagcccctaggagggtgcagtgaccccaagcctgggaggtgtgaggcctggatttgctcccatccgatctctttcctcatgtagggtgattttattgtcataaaatcaaaggtcacttcctatgccaagattcagtaattctagaccatatctggtcacgataggatcagaaaccaacagcagtactttaaaaccaaagaaatgtttgtgttaagctgtcttggcagaaaatctttaccggatgaatgtgttaaatagtcctgggcctgggtttccaccctgatgatgaagtccagacgctcagagctgtttgctggccccagcaacgcgccctctgctgggcagtgcctgcgtttgtggctagagtgagtaccggtggctggtcttcctttgggtcacaggcctgtggtgtttttcaggtccctccggatcacctggcctgaacggcttgcatggattgaaaggtcagaaaggaactaaaggtgcttcaggtaagcacctaatcgattcgtaacagactgagcttcagtccatggttcatgagagaaagtggtaccctccctggtatttctgcacttcatgagatttggaggcaaaactgaaaaaaactggcttaggttagagacacactattggagctatttttagtgctgaaaatgacatatgaaaaggacatttgagaaaaccctatttaagaaggaatggttggttaacagtgtcttttgttggtattgcttggaattttctgtccactaaaagtactctgaacaattgagccagatttcaaaatgttatcctaacaagtaaatagctggggattttagaatttttgtattaagtatagtaatgctatgtttgaccacatgggtcaaattagtactaatagcatccttttatggccactgctaaaacaaattacctacacaatttgctgttattttcataccgcaaacaggttaatctttgacaagtgtatcttgttctgttagtataatgcacatttgttgcgttactttctcagaaaaaccgcttatgatcagacaaagtagctgaaacctaacatgcaaatttgagtgaccctggggaagaggaattgtgctgctaggtttgaatttattgttggagagaggtgaaatctttctagtttggaagatccagtaatatagtcacttaagattcatttagtagatcctccaaatagattaaatgtgtgtgccttccaagaaaacactgatgtccttccttcccagtgtgaaattccacaatagttctaatcatgccagtttccacctcaaatttcaaagcaacttatgcataattacttattgtatctcatttgtttttactctctccattgtagaggtgggaggttggtattgcctctaagttgttgttttttaaaatctggaaaataactataaaagaaataaaacttatggctgaccagtgtgataggtcctaagagagaaatggtgcagacatttggatcaccactgcaaccagttgttggtgtctgcagaaccagccactcctctgccgctattgggaagtggttccttttcaggcactataacagggacaagaaaagagaagatatagtattaattctgttttccccattaaggtttgcatgatgtggggccacctggtccagtgggaatacctgggctaaaaggggagagaggagaccctgggagcccaggaatctctcctccaggtcctcgtggaaagaaaggtcccccaggacccccaggtaagctgtagcatgctttgcccttctttcaataactaaaccaaaaccttccaaatgcaatgaggataacatgtgaacatgtctcttcttagggagttcaggaccacctggtcctgcaggtgccacaggaagagctcctaaggacattcctgacccgggtccacctggagatcagggacctcctggtcctgatggcccaagaggtatgagagaatcatgacaaaggatggcagtgctccctttgttagatgctgccagctctggaggaatgtgggaccagagagtggcagaatagaagcactgaagcagccccccatcagcttggcaggtcgataagtgggacacagttagggtgggactttgggtagtggtgggctctcaggaccatatccaggaccaggacttggccctctcttcaatttcagctctgttagaccctcgtctcttcaggctagaaactgataagcaagcgtttcttatcaccagcttgatgctgaccaaatgtcttcagaagtgggtggcaagtgggaatcgcaccctccttgttggtctctagcaactgtcacataaaccactggcactagcccagagtgacaggatgcaggcttgtggcacacaagaaacagtctcttcatgtgctgctgacagtacatgttgtttctttcatcacttcacagggacaaactttggtaaggaaagatgttggaagtcattactaagctgaccaagtaggtttaggctagagctgggttgggagttgggagaagagtgtggctccgtgtgatatcttgctaaatgcaggcaattgcattcatacaagctcttagaactcttccataaagacacatgcccatcatctttgaatctttaggattttagggatcatacactgaaaataataaagctctcaaaagtgcgctaagaagtacagaagctaagtaggaatataattggggtcaatttattcctatttgtgggaacttgttttccattaggattataaatttaatcgagtgaacattcctttcccaccagacatatttcctcaaatgcctgtctatctgtccatcagtctatccatccatccatccatccatccatccatctgtccatccaaccatctatccacatatccatccatccatccatcttatctatccatccaaccgtctatccacctatccatccatccatccatccatccatccatccatccatccatccatccatccatcttattaaagcagtaagatggcaatgcaaacaaaaacccaaaatgatattttcaacaggaatgactttgaagggaaggaaggttttgcttgggttcattttgtctaacagttaccaacccattatctacaccatttctcaacttggtattatgattcattctatttcatttctgttatcattgactttcttattcttctaattctctttattccttgcttgcaagtcattgaattgtttttcttcggaagctgtcaagcagccagtatacacattcgtctttgactaaaagaatatttttgtctcttctctgtggtcaggagcacctgggcctccaggcctccctgggagtgttgaccttctgagaggggagccaggtgactgtggtctaccagggccaccaggtccccctggcccaccaggccctccaggatacaaaggctttccaggatgtgatggaaaagatggccagaaaggtatgaatgttgttccgttaagtaatatgtgaataacttggttatcttacccttgagggtctggggtactgtgccgccatttctatttcctatgcaaacaaagtgactaccttccaaaatgtccttatttccccaaagagtcctgaagtttgggtcaaagttggacaagtaaaaggaagaaacacaagttcatctttagcccctaataatactcttgataatcttccaggccagaattgaacagtagaaatgtaatgcaagccacatgtgcaatttaaaaatatagtagacacattttaacaagtaaaaacaagtgaactttcatactttatgtgatttaacataatatatttaaatatttttattttaacatatagttaatatacatttatcaatgagataattgagctgattgtgcaaacctaattccttttgcaaataagccactccttcttcctgcttttgaaatcccttgtgtgttccacactgacagcacagctcaggttggactggccacatttcaagtgctaactagccatgtatggttagtagcttctgtattggacagcttagttttagactgctgactttgcttttttatattcctgcaaagatcccgaatcactgaatttccccagtatttgaggttaaaatatttattttaatcaatttttatccaactgctaatatttggggagatcagtttttggtcaccagaatttcagagaatttttaggttcaaagaagctttttgttgaaaaaagatgactaatgagtatccattttaacttccctatttcataaataaggaagctggatatcagaaaagcaacagttgaaatttgcaaaaagagcccagtaacgagcaccttgcctgagttctgaaccaagtgtgaaataaggcaaaagattaggtcacagataaaaatcactgtgaggccgccatgactatagtgcaaatggcatctgtggaattgtgcagtgcacagcctgtagaacagtatggagcaagcctgttcatctgtattagcaatgaaatcaattttagagaatgtggctcaaatctatgggtaagtaggcttccaatgattgaacttcagaattggactgacgtgctaacactctagtcaccaagaggaaggaggaaggggctggctaacactcctcctccttagttactctagggaataaatctctacctggacatgaagttcaggactgaggaaataaaacaccatatgaataccagtgatctacataaggatacacagggagttagaaatattggtggaaccgctaatcatgcttcttgactcccagtccagagaatataaaggccaaacagtgcttcactataaagagagtgagtttcctcagttaccttttatgacttacacagtgacaaatatctcttaggcacctgcaggaatatagcagtgaacaaatttaagtagagtttctaatctcataaggacagagtttccgcttgactcagtggttcatgcctataatcccaacactttgggaggccaaggcgtgaggatccctggaggccagtatagttcaagaccagcctgggcaacacagtgagacccccatctctacaaaaaaattaaaaaattatctgggcatggtggtgtgtgcctgtagtcccagctactcgggaggctgaggtgagaggatcgctggaacccaagagttggaggctgcagtgagcaatgattgtgccactacactccagcctgggtaatggagcaaataataataataataataataataataataataataataaatttcttttataaagagcatagtttcatggaagacagacatgcacatgaaaggatatgtcagtttaaatccagttaagtgtcctgaatgaagagcttatcaaaaagcaactaaacttcagttgggattccagggaaggcttccctgagaaaatgaaactgggtcttatctctaaaaaatgaggaagacatcatggatgtggaagaagtaaaggaacatcacgtatgaggaactgaactgttgtgcctaaaactaagagagtgaggaggagagtggttgaactcgcctggggaggcacgttgttcccggatattgaaagctctttcctgatttttccttcagttccagtcctttgtctccagaggaagtttagggttataggacttcttttcattgtaatttggtcttgtcttgatcatggagccatttccttagttctttcggccgatcatgtgtttccttcagaggcaacccgtctaagcctcacagaagaaggcgaggctaatcttgactctcaggctagctatgccctgcattttgttggagtgaatctctgaattcagtctatcaaactgtcattgtttttatcttgtctcattccagtgccctcatttttatgttttgtttttttttaaggaccagtgggattcccgggaccgcagggaccacatggatttcctgggccacctggagagaagggtttacctggacctccagggagaaaagggcccactggtcttccgggtgagcttccaacctacatacagcattttgtttaaacatttactaaaatgatcatcgttcagaaagtagttaatattctgaattactagcacattcttattatttaagcccttttcttatattaagagtatatttctttcaggccgcactacaaagtctcatgtttggtaaagtaataatttattgtcaaaatgaaaaagtttgaaaattaggagttgatttttttttactttattttttaatttttttctatatatatatattttttattatactttaagttctagtgtacatgtgcacaacgtgcaggtttgttacatatgtatacatgtgccatgttggtgtgctgcacccattaactcgtcatttacattaggtatatctcctaatgctatccctcccccctcccccctcctcccactccacaacaggccccagtgtgtgatgttccccttcttgtgtccaagtgttctcattgttcagttcccacctatgagtgagaacatgcggtgtttggttttttgtccttgtgatagtttgctgagaatgatggtttccagcttcatccatgtccctacaaaggacatgaactcaaaaaaaaaaaaggagttcattttatatacacatttttttttctattttttttttttttgagacagtcttgctctgtcatccaggctggagtgcagtggtgtgatctcagctcactgcagcctccgcctcctgggttcaagtgatccacctgactcaaactcaagtatctaggattataggcgtgtgccactgcgcctagctaatttttgtattttaatagagacagagtttcaccatgttggcaaggctggtctcaaactcctgacctcaggtgatcagcccacctcagcctcccaaagtgctgggattacaggcatgagccactgtgcttggcccacatagactgtttctaagggaaataaatatgtgttccttcatgcaagaggcaaagactgatttgattattatttgttaggatcgtatattcaattccgatccctgaattttcattgattttcctagatgttttatttaattttttttctgtaaattccattcgttcctaggaagggagaaagctattcagtttaactctataggcaacactttttaaccatagggtcaaattacgacaaggaagagttggggagagaaggggcaaacagacatgtgtatttgagatgggcagaagtaatatctttcaagatcctaaatcaatattacggtaatgtggcgtcagttcagaatatttcgcagtatcctaaattagcactctagtccaaagaataaataaatagcactgctttatgatgtatcataggacaggaggaacaagggcttatatgttgattctttttttttttttttttgagacggagtctcgctttgtcacccaggctggagtgcagtggtgcgatctcggctcactgcaagctccacctcccgggttcacgcccgttctcctgcctcagcctccggagtagctgggactacaggcgcccgccacctcacgcagctaatttttttgtatttttagtagagacggggtttcaccgtgttagccaggatggtctcgatctcctgacctcgtgatccacccgccttggcctcccaaagtgctgggattacaggtgtgagccactgagcctggcctatatgttgtttcttttcatatttcctttctatgcataccctatacttggcaaattaatatgaaattttcagaagcttttaaatggatagaattcctacatgcattaaattagaggatatttgccagaagaaatcaactagaattttatattgctcaagagagtttcaagtcattctagagatgaaaactccgttactaaatcatagctgctcctgtcagtcacattgatgtggacattttatgtaaataaggtgctgccattctgcttgtcattgatgctgcctcaaattattatgtatgttcttaatctatttcatttttgtcctaatccacaaatttaaaatctctttccaccctgtgaaaatcatggactggcctcgtttgttgtctttggatccctctaggtcccagaggtaagctttgctataaaattggtaatttcccctcactctggtttctagtcatttctgtacttgtcctttttcctctgtatgtgtgagctaaactttgttacatttttatagatggggtgctgtaaggatattaagctgcagtgttttgcttcctcgttacagatatagtaacctcatattagagcatcctaacattcagcctcattataggttgtcaaggcagtgtagagcctttgcttatatagtttcaatttgggcatgaagtatgtgggctttctctgtcaaaggctatatagtacataaccaatgtaagttccttttttaaattctacaatataaatacctagagcatccctaaaataaatggtatatacaacattaaaaaatggggcctcacctcccagtaaggggctgtgacaagcctttcctatcacaccctcaagtccattttcaaggagcacatttctttgtgtgttaaaaggaaaatgttcacttaatgctctgcagtgcaaaaacaatgtgttattttgtgcctggcattttcaaagaaaatcaaaagcatttctcagaagagaaaaagaaaaattgtgaatgcctgcatttgttctttccaggcctctgttattagtcctaatgaaaattgctgtgaatatagacaccatgtattatttttaaggtctttagaagacaggcctcagctccccctttttatttttcagtttctgacttattaaaaagtaaagaaaagcaaaatcaaaaatgtaaaaagtcctggtattttcaatgtttatatttaaaaattaaactgtatttgatgttttcatttcaatcctgtctctctgtgattgtatgtataaagtcatttcaagagagcatcaaaattctaaataggaagcaccaaacacatgctcccactttctgaactccgttcccactgggaagggccagacattactcatggaaaatagaagatgcctctatgcatctctctcaagtcacccatagtagaaaagccaagttttacattaaactgtacttattataaaaatacatttggccctgtgtggcttgtggttttataccatattttacacagagttaaattccaaatagctcataagaattccaggtcattttacacaggcccagtaagtattaggagactaaaactttgttgttatgccacattttgttaaggattttcttagtgctttatgattgatgttcctgaaattatttcacacttttgcatacatttgaagaacaccatagctaatcagatgatatcttttatttttatttaatttttttggagacagagtcttgctctgctgcccaggctggcgattccaccactgcactcccaggttcaagcagttttcctacctcagcctcccaggtagctgggattacaggcatgtgccaccacacctggctaatttcttgtaattttagtagagatggggcttcgccctgttgcccaggctggtcttgaactcccaaactcaggcagtccacccgcctcggcctcccaaagtgctgggattacaggcgtgaaacaccatgcccggccagatgataccttttaaaatatgtttcatttcttagaatttgttacccagatattgagagttcctgatgcagtctgatgaggtggttaagaacatgggtttggagccagaatgccctggattgcaatccagactctgctgtgtgtaagctgtgtcaccacagaagtgtcacttatttgcctgagcctgagtggttttttttgtttgttttttgttttttttttttgagacagagtcttgctctgtcaccaggctggagtttaatggtgtgatcttggctcactgcaatctccgcctcccgggttcaagcgattctcctccctcagcctcctgagtagctgggactgtgcaccaccacacccggctaatttttgtatttttagtagagacagggtttcaccatgttggctaggatggtctcaatctcttgacctcgtgatctgtccatcttggcctcccaaagtgctggaattacaggcatgagccaccgcgcctggcgaagcctgagtgttcttgttcatacccttctcataacagtagcacatacacagtcttctcgggaggatttaatagtaaaagcattcagcacagggcctgatacatgataaagcattcagtgagccttagctgttgtcattattgttcagtgttattatttcttatccctctgtgatgtttgcaggatgactgaatgaagctttagaaaagatgtcttaatgatgtgaaagtaaaagaaaaaaatctcacatctttagtatagtggttttcttttttcttttttttttttttgagatggaatcttgctctgtcacccaggctggagtgcagtggcacgatctcagctcatgcaacctctgtctcctgggttccagggattctcctgcctcagcctcctgagtagctggaactacaggcacttgccactacacccagctatttttttttttttttaagtagagatggggtttcaccatgttggccaggctggtctcaaactcctgatctcaagtgatccacccgcctcggcttcccaaagtgctgggattacaggtgtgagccaccgtgcccagcctgtgtttttcaaagtgagattcccagatcaacgccatcagcctccctgggaacatgttagagatgtacatggccccctcttcagaccttctgactcaggaactctggtttctaacaaactagcgacacaattctgatgtgctacagtcagaattatagctttccaactgtgctttcagccctaatggacactggaatcatcgtgggagttaaacaaacaaacaaaccaaaaactactgacacccgggtcccacccccagaaattcctatttaattagtctagatggggccccagtattcatgagtacttttgaaaagctcaccagctgagtttattatgcagccaatgatgaggacactgctcaggccacatcctattatcaagtaaatcagtatttctgggagtgggacccaggcatcagtatatttccatgactcccctggataagtccaatgttcactcaaggttgaaagtcactgcttctgagcctctagcaatcctgaaattctatgttagtgactgacactatggaaacccacgtggctgcagtgtagagtaaggactcagggacacatgaagctgagctttaggaacccaccagtccctcttgcaatgctacctgtggctgctactccagtaaaaaatggcccagagattgggcaatcctgtgagggtcatcacgttgctgcatcatccgaccttcactgtttcatacttctgcatcctctgatactccattcactcattcggtcagcccgacattctggaattttttcatgtaccctccagggcataagacaaatttctgccttcatggaacttacattggattgttgaatctttacaaacatttatactgaattttatactgaatttgtactaaatttcagtatagtgtcagaagtccaactttaaccagagactgtagaaggagcttgttcataagcacgtgcatccattacacaagcggtgattccaatttcaggtgaaccggggccacctgcagatgtggatgactgtccccgaatcccaggccttcctggggcgccaggcatgagaggaccagaaggagccatggggctccctggaatgagaggcccctcaggaccaggtatgagccgcatgctgattgttcattattttcatgatatattgctgaaatgaaattctagatcttttattttgtagctttttatatggagcctaaactactgaggagaaagcatgtctttccctttgcaatttgtttctaccttgatccaaagtacatcaatcatgggctaactggatccacacatcccttctattattttattttattttattttatttttgagatggagtcttgctctgttgcccaggctggagtgcagtggcaccatcttggctcactgcaagctccgcctcccaggttcacgccattctcctgcctcagcctcccgagtagctgggactacaggcgcccaccaccacgctcagctaattttttgtatttttagtggagatggggtttcaccgagttagccaggatggtctccatctcctgacctcgtgatccgcctgcctcagcctcccaaagtgctgggattacaggcatgagccactgcacctggcccatcctttctatttttatgtggaactcctacttaaatctttcattcttggccagcttttggatgtagagttttcaaacctcttagcacaacatggtagatgctccatgaacagtcattaatagctgcctacttgattttgagttaaaaacaattgaattggggcttggtggagcggaaacagagcctgcaagaaggaagtaggagctgttagaggagggatggggaaaaatagggtcttgctgtacgttttggcagttactacatggttaatcactggagcattgttcagtaactgccggggtggcaggatccttattcaagtatttaagcgaaaccattcttttaaaaagtgttctccatttaaaaagtgttctccagccaggcgcagtggctcacgcctgtaatcccagcactgtgggaggccgaggtgggtggatcacctgaggtcaggagtttgagaccaacctggccaacatggtgagaccttgtctcttactaaaagtacaaaaattagcagggcttggtggcgggcacctgtaatcccagccacctgggaggctgagacaggagaatcgcttgaacggtggaggcagaggttgcagtgagctgcactccagtctgggcaacaagagcgaaactccatctcaaaaaaaaaaaaaaaagaaaaaagtgttctccgaatggtttgttttctttccacatatccccactgcattgggtaatttacaaagatattagggagcccagggctgggcatctagaagtcactgttctctttagatccattgatagtagctatgagtctagaaaactcatgggcaaattctttgaaaaggaggaaccaggatgttctctctcctttcaccccccctcactgccccactatgatttggactttttttggttcagggacacaggaattggaagcagaactgaattttgtaccacttgtttttcttgtggttccccaaaaccaagaagttaagtgcccaagagatgttcctctcaacaggagtcagactcgttcttaggtggtgaccaaaacagccctggagccttcctcaaattaatttgggttttcgttgtgtgtgtttattgcattgcatctgtgtttgtgcaccaggttaattgggtgttggttgtagcaactttttttaacggcccgtgagaactgggaattgggccagtctttatttaactcatctttcttgatactccttgcatgcataaagttctgtcagtcggtattactagtcatcaacctcattttaaaaccaagctgccttgtgtatatatttgcaatatccagagctgggtccctccaacttaaaaaaataacttccaacttgaagacgtgacctataactgggttctgcaaattcaattcagtaagtacttccagactccctctactctttgtaaagtatgctactaggtggtatgggtgagtaagatgagtaagatgtgttttccccctccagggtctcataatcccatgaaagaaatagccagcagaatataaataacttaaagtaatggtagattattacacaattcatgttaaaaaggagttgcaagttgggtgttgtggctcacgcctgtaatcccagcactctgggaggccaaggtgggcagatcacctgaggtcaggagtttgagactagcctggccaacatggtaaaaccccgtctctacttaaaatacaaaattagctgagcgtggtggcagatgcctgtaatcccagctacttaggaggctgaggcaggagaatcgcttgaacccaggaggcagaggttgcagtgagctgagatcgcaccactgcactctagcctgggcaacaagagtgaaactccgtctaaaacaaaacgaaacaaaacaaagagttgcaagtcaagggtattgggagaatgggatggtgagaggttaattccagtgtggagaactacaggactgctaggaccccagtaagagctggtatttgactagagccttaacgaaaggttgggctttgaggagccagaattgttcaacagggagatggcgggagcacagactgggctggttggcctaataaccaggcatctaggagttagcaacatccttgctactgtaactgtggtcctggtccaggaactagcagcaactttggtcccgccccagacctacagaatcagaatctgcattttaacaaggtccccaaaatagttgcatacatattcaaatttgagacgccctgttatatgaatgcactccttaaagattcagctaagagtagaacgtttcttagcaaggcagtcctagctgcaggttaaaatcacctggaggatcttgaaagaatattggtacctcggcctaatctcagaccaatagaatgtggaaggtggcagagcctgaatgttaacatttttcaatgccccccaggtgactgtagcaggcagccaaggttgaaatgcactgctccacctcaacatcaaaattgaggccagagggatggttggggtcacccactgtggtggctttaaaaaaataaccaaagaaagtaactaggaagagaaaaatatgtgaatgggtcaattctttacacttgaacatgatagttatctttgacatgaacaagaacaagattctctctccatagactatgagcttctgaaagatggtctagtgcttatgtggcccaggtgtgcttgcctgtaatctctaattcccctgacttagggtttcatgggctcatctgctgcacgtggccacaggagggccttccctgggttcctgtgccctctctttattggagccactgaccctgcctgctggaagtggggacactccaaggccacctctctaacacctacatgattatgatgttttttaaaaagtgccccgtcgttctggtgaagcatcgccttctcttcctatgttctcaccatgtggcccagcttccctggggctcctttttgtcctgtgcacccactcccaagcccttgctttcttctggggcccctcttctctgataggagcctctgggttcctgttacaaaggacctctcttctccgccatgtattcctcggccttgtctatgcctgctgggcacactggctgtattgctcatcccgtccagttactaaagagtgacaggtatattctaagggcctaatgccaaaccctggctgacctgggccatctgtaggccatgttgctcattctctagcatttcctgaaggtattttttcagcagggtgtgaggggccatatacaccactccagcctgggcaagaagagcgaaactccatctaaaacaaaacaaaacaaaacaaaagagttgcaagtcaagggtactgggagaggttaattccagtgtggagaactgcaggacagctaggaccccagcaagaggtggtatttgagcagagccttaaggaaaggttgggcttatataccaccaccacatataccaccctcaagattgggtgctgaaaagaaatggctgccactagaaagaacaatgttcacttaaaatgatgttgttggtatcttcctgttttcccttcagaatcttctcttttctgctcctctacctcctcctcccctccagcctcaagtagacaaaaaagataactactgagtactgggcttaattcctgggtgatgaaataatcatcagtacaacaaacctccatgacatgagtttacctatgtaacaaacttcacacgtacccctgaacctaaaataaaaggtaaaaaaaaaattaaaaaatcttttctttcattgctaagctgattttgtaaccatgtgctacagctgagacttacctaaaaatgaacaaacttctggctctttcctgcccaatatgggtggatgacagccacacgaagtgggtcgattagtccaccacaggaggcctaatgctcttctacacacagatctctttgatctacaacttttccttccagggcggccctcaaaggctgaagcttcctacagtgaactcaaaagtgttttccattttgttttgaactgttcctgcctaatggatgtacccacaccctgttagggttgtgtttctcttcaaggcaacacttgccctctcaggaggtcatccatctaacactggagggtttgttttgatgtttagttttattccttaaaactaattccaagtagggaacaagtccgtaaggtggaaagctctgaacatagagctcaggttaataagaagagccttccttcctgtttctcaggaaatgtcttccgcctgacaatttctctttgcctcaccctaaagggagtaaagcccacgtgataacgtctggtgtgaggactctttttcccagatctatagtgatctcaccatgagtctatacatcaggaggaatccctgctgctgcctgttcagtggaagggagaaactcctaacccataagcactaaggcagccctttctagaatatattgcatgttggaatcatcttgttgggtgagacagagaaaggaatgctctgagctcactgttggggccccatgttccttccaagataactgatactctcttggaaggtggtggagttccagattccaccaggagtgccaccccggggagaggtttctgcccagtcaccaggaagggcagggctcctctcacccagatggggaggcggggatgtttcctttctcacctactgaatggtaaccacatacagcatgcagtccaggacactctgaaataattcgtttctaatcctgggagcacaaaagcataacaggagcatatcggacactgggatgtctgcactgagtgtagctcaaccagcacagggcatggaggggagagactggctggtcgtagggatgtaagaagaaggggacactctcaggcaggcaatatgaggacgtgactttacaatcagtggggcgtgtggaaccgagggcaggcaagtgagacatctacctcattacctgaacacttcaatcccctgcttcagctttggagccagatgatctttgctgcgaccactcaaccctgttgctgcagcatagctgtagataacacgtaaatgaatgcctgtgttccactgtaactggggttactaaaatgggcagtaaatggcccacaggctgtaatttgccaaccactgttatagagaccgtaagaagcttgagggcaggatattgtcttattcagtgtgatatccatacacaggcctgggtcatggagggtgtttggtaaacatttggtgaatgaacacgtgactcctggatgtagcctactgtgtggagcggtttctcaacctcagtgctgctgacatttggggcccgatcgttctttatcctggagggctgtttggtggattctaggatgttaagcagcatctcttgcccctatcctgctagatgccagtaatgacctcttcctccatgtgaggacccaaaatgcctccagacattgccaagtgtctgctggggtgaggggtggggtggggcggtgcagaaccacctaatgttgaagaccatttatgtagggaaggatgtggtaggagatgggagatgtacctttagcctatgggggaggcatttggtgaaggggaagaaaaaaactttattacaaaagaaaaaaaaaggtaacttaaaactaaacacacttttaaaagacacaattgcctgtatatttttccagttttatttctgcacgatcatcctaggcatacttgttggcaaactgttcttaacataaccttacttctatgtcattgcgtattttcctacaatattatctgtagtagctgaggaatattgccttatctgattgtgccataatttatttaaccactaccttcaccaattattgattggtttgctgccagctgctctgctagaaagaagttaatccaacaaggccctgctttttggagccacaggctagcagaaaatgaagacattgagcaagtcagtttggacatgttgagtgttaataaggggtaatgtgggaatttctaacaggggagctgaacctgggggtagggagggggcgtcacaaggaacatttaaggctttggttctcgagcttcatgaaccatcagaatccctgaggagcttgttaaaacacagctcgctgaggtcccccccagacctgatttgttaggtaaggagagggctctgagagtctttatttctaacatattcccaggtgctgccgctgctgctgctggtccagtaactactctgatttaaggagtttccactttctcactacgataagcaactggtaatgatatcttacttatacgcatccctgattatcatgaagaaatagtgtaatggataagaacagaggttctggaaataagggctgggtgtggtggctcacacctgtaatcccagcactatgggaggctgaggtaggcagataacctgaggtcagcagtttgagaccagcctggccaacatggtgaaaccctgtctctactaaaaatacaaaaaaattagctgggcttggtggcgtgcacctgtagtcccagctactcaggaggctgaggcaggagaatcacttgaacctgagaggcggaggttgcagtgagctgaggtcatgccattgcactccagcatggccaacagagaaagactccatctcagaaaaaaaaaaaaaaaaaaaaaagccaggcatggtggcccgtgcctgtagtcccagctactcgggaggcagtacctttagcccttgcaggaggcaggagaatctcttgaactgggaggtggaggctgcagtgagccgagattgtgccactccactccagccagggtgatacagcgagactccatctggaaaaacaaacaaaacacaaaagaaataaaagagcagagattctggaagtagatgacatatgttcataactctggctctaccacataagccatgactcagtttcctgatctgtaagaagggctgattgtgaggattatgtggattcactaacataaaaagcacttagaacacagcctgacacagaataaacagtacttgtgtttgctattattgttgtttctttaaactaaattccctgagtagaatttctggttttaagaataggcagaaatataggattttcaaaatatgccgccaaggtcatcaccggaaagagttttaaagttaaatcatctagagcactggttctcaacgtgtggttcctgggactggcagcatcagcatcacctggggacttctagaaatgcagattctcatgccccaccccgccctaccaaggcagatgctgatttctaccaaagtgtgagccagtgttccagaatgtcattggggttctgttctcaggagcagtaggaccgtgtcattgcactgtttagccctgtgtttcctattgatgttgctcaggtgggttggaggaggaagattgagtccagggttgctctaggcaagttagctactctactacttgtggacgcacagtcggggcctcacctggggccgcagaggggcagggaggggcctgcgtgggaaatcttcgattcttgctagcttgcaacatcaagtcaaacctccttaaacctccatgcatccttttcatgacagggttgctgctttaagggtagagggtttcggtcagcgtctgtgttaacacactcatttaatggttatcaggcaaggctggtccctcagtagggtgggggagggaggctccatgaattcctgggttgactggcatcctcagctttatcatcatcccccagtcactggagggtgaaggcaagaagcaacagtgaaagccacttaagcaagcccctttgatttaatgtttgattttaggctacgtgttggtctgctcgggccgccacaacaaagtatcactgacacagtggcttaaacaacagacaatttttcacagttcgggatgcagaagtccaagatcaaggagccacaacagggctggtttctcccaaggcctccctccgtggcttgcggatgccaccatcttcctgtgtcctcacgtggcctctcctctgtgccattccagggacatgcatccctggggtccgtttctgtgtccaaattttctccttgcataaggaggccagtcagcctggattagggcccagcctaagaggctcattttaacagaatcacctccttaaaggtcttatctccaaatacagtcacattctgagatacggggactaggacttcaacatatgaaatttgggggtacacaaatcagcccataccaggctactctgtggcagagagagagagacagagagagaaagagagaaagagaatagaaaacaagtagagactggaaacctggagaaggctagtaattcaggaaattaggtataatagcaataaactccctcaaagacaatgattgtgtctgctcccctgaccgaagggagatggtggctaattatttgaggccttgacaaaaaagtaactgcatacttaaagaaccccttaaggattaacgcaattgctgccaagtcccccaggttatatccagagctctgcagcttgtcaggcgcagggtctggtggttgatggcctctgcacttggctcccttgggcctaagtttcctctccacatgtgactgctctgtgacttttatgagccccagtctcttcactggtataactggcatgtatgagtacctagtcatatggctgctgagaagactgaattggacaatccacgtaaagggattagcatggtacctagcacattgtaaacactcagtaaaaagctattttaaaaaattgctgcacctatcatgctccagatttaacgtgaccccaaatgaaaccgattaagtttcattcatttctccatctaggctttgaaacaatcattattaaggaaaatatttattataaatgccatacatgttcagtagtttttttttttttttttgaagtcaaatatatgaagactatgaagaaaatgtgaaaacctgtctctcaacacctccctggtctggcttcaaatcctggcctagccctttatgggatcactgactttaattaagcaaattatttgacctctcggggccccagttacgccaactgcaagtggagatagtaaaatcccaacttcatgtcattgcaaagactaaatgagctgatgcattcagtcaaagtgggaaggaagcctggggctggcacacggctggcatacggtataagcacggtaaatgctagcaggtgtcatggttgctttcaccaccagcatcataaacttttgtgcagggtgcaaaggagagcctgggctggatggcaggaggggtgtggatggcgtccctgggtctcctgggcctcccggacgtaaaggtgacacaggagaagacggctaccctggaggaccaggtagagtttcagtcactcctcttttctctgacactgtaaaccttagagttgtatacaaaatctctgatctctcaagtggctttccaaactggatcctattcagatcatttgccttagatgctgactcaccaggtatcagagacagaaacaatgagaacagagtgggatgcatctcttatgttctaactgatgttaaaccatcataaaacctagacaaggccctgcatcctattcagtattttcccaaactgctatacatcatcatcaaagtcttggccatttctgcagttcacttttcaaggtcatgaagggacggtcagcctggtggctgtgggatcacccttaagaggctgtgatgaagacctcagggacggtgtgtgtgttctcaccctctccaagtggccaaatcgcctggtttcctgagttcacttcatcttatcatatagccattagtacactgatgtagaaaacagggctctttcttaaaagaaaaaaaatgggaagtggtgttgggaaaggggacataggactcttcagaatagaagtgtgaaacaatgcaccatgtagctcgttaggcgcatggatccaaagagcctgagacacaatcccatctccagagagtccctggccagggatgcaaactcctgtaccaggttagtagtgagtagaaacgaatgaggagggctgggtgaggtctgtagcaaaatggagctttggctaaaagctgcagcgcagctccagccaattatagtctacagaaatgtgggcctacactctacactctcttcgttcaaaatatcaacttgtaaaatccttacaggtcaaaacacacgagcaggcctgattcagtccacaggctaccactttgtcgtctctggttgacagtgtagatggggagagcctgccagtcttgcagaaccaagggtagaacacaaaaaataccttttggtttcaatgtctaacttcaccttttgctcttggcaattagaaacagctcctggccttctgcaatagttcagccccttagaggtgccgaaggatacagaccctgctcacgttctctagaactgttgatttcccatctgccaacaagaatgctagaacaaggccttccttccatttccctctcttctcgaagaggagagccaaacttgtagatgtggatcccaagcctttggctttctcagaatggaactgataatatgctggaaccagggaagaggtctgggaggtgtaagaaagaccgactttggggagcacttgctcagcagttcagtctggggagtccacacttggggtgtgtcattacactgtccttgttcttttcttcccagcgtatttcataacttaactttttgttatgcttattgtttcttatttctctctcttcctcaagtgtaatgcaagctctatgagggcagggattttcctctgttttttgtctttatgctaatgtagcccaggcatctaggagttgcttggaacaaatacttgatgaatgagttgttctatgtactgcagctgtgtagctgtgtacgttccagaaggcgaggaggggctgagtcatgctcccctctgctccctgagtgcttagcacagtgccagaacagaggtgcttaacatatttgttaaaccaaaccccctaacctgccttcaatttttttcctttgttcctccagggcctcctggtcccattggggatcctgggcccaaagggtttggccctggatacctcggtggcttcctcctggttctccacagtcagacggaccaggagcccacctgccccctgggcatgcccaggctctggactgggtatagtctgttatacctggaagggcaagagaaagctcacaatcaagaccttggtatggatacaggatcgcccatctccattgcctgaagagtaaaatttggggttaattttactgattcatcagcaccttaaatgatcactaaccttatatgggattattcttacttttaaaacaaaaacactagcatggtcattctcagctaatcctttaaacttatgatcctatgaagtgtcaaagaagctcattctggctataattattatctggctataataagtatattattattatctggctaataataagtatattattagttttataaaaatgattcttcctcagtaagttaaatgtaactctgttatgaaatgtactttttgcttccaaatgtaaattaaccagaatgtggtcagttcctgtacttacatgtaaaatggtgcagccacagcacgctgatggttgtgttacggcacttgccagcatcaactccctaccctactccaatttaaattacagaactttattttgagggtcatcttttggtgctccttgtcacttctccgctctccgctcttcccctcccctaccttcccctcccctcccctcttctcttctctcttctcttctcttttctcttctcttctcttttcctctttttttttttttgagatggagtcttgctctgttgcccaggctggagtgcagtggcacaaccttggctcactgcaacctccacctccagggttcgagcgattctcctgcctcagcctcctgagtagctgagactacagacttgtgccaccatgcctggataatttttgtatttttagtagagctggggtcttgcggccaggtaggtctcgaatatctgacctcaggtgatcttcccgccttggcctcccatagtgctgggattacaggtgtgagccaccgtgcccagcccttgccaattttcaatagtagatttgcaagctgcgggactgatttcaagtcaaaggcttaagtacctggctgccgggaaacactgtctttccaagaaaatcatggttagaatggaaggtgcaggaaggatatgctgacggggacagttgacggtgaggtgcttgccattgctctcactaggcagtgaccccagctgttaaaaagggtagtcaaagagtgcaagcctgggctggcaactacttgtacatcccctgcatttctcccttgggtttggccatggcctttcccatcacaaggggctagtttctttgagcacaggagaaaggaggaagtgatgtttaatatcctgaatctgtttccttctctccttctctccctctgccatcaatttctttcctgcctggtctttgtaccatcatccgtcttgcttctcccaccttggtctaaccagagcacacatcttaaaactctgcagaactcttgggataaagtccaaactccttaacgagattgacaaaggccacatccaatggtctgatttatcactggacactcctgagacagacagtgcagacaccctctcctcatagtccctgcactgaacatgtctgagttctctgagctccacgatcccttatctccaaccccctctgacggtatatctcttttgagtagtcactaccaccatctccaagcctggctaaatcctcttcatatttcaagtcctaacttaaaatcacatattccagttatccttccttgaggtcccggatccccacacttctcattcttagggcttgttgtgctgtattttcattgcttgtttgctcatccagttccctgctaggccatgagcttcctgaacacagagatgtgcttggtgcccacctccagcacctggccccctgcttggctcgagtgagggatgaggggatgagggctggcccacaggaccagggaggtgtcagaaatggcttcctcaccacagaagcaggctttggcgagggcctccagatttcagaacacgtatctgcaaaggccagatggaggaaggaagggtctgggaacacctacatggggtgcttggacaccagctgtctcttcttcccttcccaaggtctggcagggtcttgccttcccgtatttagcacgctgccctttgcctactgcaacatccaccaggtgtgccactatgcccagagaaacgacagatcctactggctggccagcgctgcgcccctccccatgatgccactctctgaagaggcgatccgcccctatgtcagccgctgtgcggtatgcgaggccccggcccaggcggtggcggtgcacagccaggaccagtccatccccccatgtccgcagacctggaggagcctctggatcgggtattcattcctgatggtgagtcccgtgcccttgaaaaccctggctcattcaccatttcctaacaccttctcccgccatttctctctggattggacagtaattctgagcactctgcgcttaggacataaggttacggggactgttgcaaaccatagcctgttgggatgcagggccattatcttttaaaaacacttgtgattgattttgatcacattggtagaatttagaagatgagtttgcttcagccatcggtgaaactggagccaatttgtgtgcatacttaccatgctgagtacgactccttttcagcgcttgtattttgttctttatggaataatctaaggaaaaatgttaagatcagacccaaacctgggtgtgtccctgattgggtctggggttgtctgtgtgtgtctgagccctaattctctcttgttttctgggtagcacacaggagctggggaccaaggaggagggcaggcccttatgtcacctggcagctgcctggaagatttcagagcagcaccattccttgaatgccagggccggcagggaacttgccactttttcgcaaataagtatagcttctggctcacaacggtgaaagcagacttgcagttttcctctgctccagcaccagacaccttaaaagaaagccaggcccaacgccagaaaatcagccggtgccaggtctgcgtgaagtatagctagagaatgcgaaattcaccaacacgtggccaagagaaacttcctagggggctaagacttcctagactgtgctaagagatgtcatggtgctcattttggactccctttcagtggttccttctgttttgtcgtggttattcccagagtcctctggttccttacacattaagcaaatgctgcacagatggatttgtttggacctcccaatctagggagcctagatactcttattttactgaggatgatcgaagaactggctttacttaaaaatatgctaattctcagaaaggcaagtagatgataaaggccagattacaaattacattactgaaaacttcattcttgggttaacagtatctcaaacaattgaagtcaattactctataatacagtgggcttctggatggattttataggaaaaaataaacaggtcaatgaatgaaactagaaagcagagattttcaacatttcaaaatgatttcctctgtaatctatttttccatatactttaaataatggtaaaaccatgacgcaaagagagatttttttttaaagaagaaaaaaaaaaattcacactgccagcgttaacagttcctttcaaaggagaatgaatcatgatggcaggaaggcccacagtcgccgtattccagagatgcgacattagcataaacacatcacagatgaatataaaacattatgttctcttctgcatttttcagagaatagaaatgcctactttggcaacccttttgaaaagtagcaattatggaaaaaaaatattcaataagagattaggagcctaaaagctattagtgaatattaaggtagttattcacaaaaattgactccccattgcagtgaacttccagacagactgcttttccccagtcggggtccggcgtgtcacaggtgcgtgcgtgctaatgggactgacgctacatggggctcactcaggcaggcacgcgcttcatacaaagcatctcactcccctccccaggagagcctgcacagcttcttgcactcacaacggacactttgctccacacacataatggcagctcacacagggacgtgacagagctatcattatgcacttgggagaaaattaagggccgatttaattaaacttaggtaagaagattcatttaagtcagggttaccccatcaggaggacatggcactatctttaaacgaaacaaagacaatttataatttgaattttatgctcccgtggttggctgttacaggagcatcccattttgccaattttaaagacattcttatatttcatatcagtcttgtaccaaggcaacagtttgacatttggcattagtattttctaaaaaagtttagaatgtgtgtcaatttataatgattatttttttctgtaaagcaaaagatccctttttctgttttgctaggaatttggtgatctaatcctaaatttaaaagatttgttggaaaaaatttttaggaaactcaccttcctcatctaaaagaaaaaggcattttagagaaaactaaagaaatttctcatgagcgtgacactcattttagtgctttgtttccgtgcacttaaaaataattgagaagaaaaactcaattaaaattttgtttataagaaatgttttccttgccaaaccttgatttgtaatgagctcttatatgcagaacacatttcaaatgagttttgctatgggctgcccccagggtggcaatttattttaagagtattttctggtaaaaagaaaaatgtgtattttaagatgaaatattttcttgatgtagcagaatatttcctagttcatttgacccatttgatattttttaaaccatgctctggcatgttgaatatttttgtgcacctaaaacttaagccaatttcaatcttatttgtgattacctttctccttcccaaaaagctttatctattaccaaaagtcaaccctcctaaaagttcaacctgttcatcttgaacttggcctgagaacattttctgggaa

SEQ ID NO: 11756 - DNA, 11752 bp, Human
  misc_feature (1)...(11752): n = A,T,C or G
caggctcccagggagacaggtggggagtatcagacccttgaatagggagcgcctgggtnnnnnnnnnnnnnnnnnnnnnnnnnnnnnnnnnnnnnnnnnnnnnnnnnnnnngccaagcttgcatccagtgatcacggccgcccaagccattgccgccaccttcctctcaggggctgcctgttcccaggctctgtggttctctgtcccccctgtgacagaagcagtgcccagggcagggggctcgcagctggcaggggcggctgtgcctgcaggagctgcgtgtgggtgtcaccactcaggcgctttaccttctgaccaggacccacaggaagggcgggggcacaccgctaccctcctgtgtccggccctacagatgctgggcacaggatgaggcgctgccattcctggtgacctgacatggatttctatccccaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattactgcctccggcctccgccgtttttctgtttcgtaaaccagcatcccggggttcctgctctgagtgaccctggcacctgtcagggagtccaggtgtgccccatgagggcctgggggaggggcaggctgggcagagccacagaggggctcccctcaaaccccacattggctcaggtgggaccctcaggagcaaccccaggtctaaagtcttcccatgggcgctgggctcaccacccccacgccagcccctgcctcccgtacccaggccggacgtgacggggccgtccctgcattctgtgctttcccagttgtacacatcctgtcccctccctcgagtctcagtcacagttcagtgacctggtgacgggaggccccctgcagtgtctgacccaggccacgcctgtgccagcccagagccagggggaggaaatgggggctgggcctctggtccccatggggaggccacccttgtccttggtagcatcagggtgcagaggtgttcccgggctgtaggggtgactccccccaccccccaaggctctggagaggccgatttgctcaggaagccgaccttcacaccttgtcctgctattaatagacgcctggttgacacgggaccctcggttgggtccggagcattgggcaggggcacttgtcagtgtttgagagctgaagtttgggaagccctggggaagcgcaggaactccccgcctgggctggggctgccgggcagggcccctcctatgcctcggcgtggctagagagggcgggggcagaaggctccgggacagccctgcaccctacagatgcgggtctccgcccagccgcggtcacctggggggctgggggcggggcctgggcggggcggggttcggccgggagcgcaggggcggcagtgcgcgcctagcagtgtcccagccgggttcgtgtcgccatggggcagatcgagtgggccatgtgggccaacgaacaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacgggtgaggctgggctcaggcgaggtctgagggcagaggcaccactgcagcagctccaggaaggacctgcaccgggggaggagtgcctgggaagggcctgggggctgagggtgaggaggaggggcccgccgccaccactcccctggggctctgagcgccctccctgttgtctggagggtgcgtggcagctggagtgggagcagagacctcagggtgggagggctggaggacggggccctgcagcctgtcctgtgcccaggaaagtgaccgcctgcttcgagtcagcggccaagaagtcggtgggtcagttcagacagctctccccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcctgagcgtgccccagggcctcggcacaagctgctgcttctgcagagcctcatggctgtctcatttatttctcaattcaaatgccacctgcctggggaggtccttccagaccgtgcagccccaggaggcagctggcccggagacagcagggccttgacaaagagtcccccctgtacacagcaggtgctctgtaaatgtggctgggtgccagaatacgtcctcagacctccctggtggcaccagcggcagctttgcaccctctttcggatggcaggctcgggaccaggacggtccccaaagatgcatggacaattggctgagtagactcaaggacactgccctcccctcctccgacgcagacagacaaacccagagagttaatgtgtagctgggctcaaaccaaggataggaaatcttccaacaagaccatgtggagacaaaaacagaatggctggcagggcaaggtggctacacctgtaatcctagcactttgggaggccaaggcgggcggatcacgaggtcaggagatcgagaccatcctggctaacacagtgaaaccccgtctctactaaaaatacaaaaaattagccgggtatggtggcaggcgcgcatagtcccagctactcgggaggctgaggcaggagaatcgcttcaacctgggaggtggaggttgtagtgagctgagatcacgccacggaactccagcctgggtgacagggcaagactctgtctccaaaaaaaaaaaaaaaaagaaataaaatagtaggaaggaccaggcgccgtggctcatgcctgtaatcccaacactctgggaggccaaggcgggcggattccctgaggtcaggagttcgagaccagcctggccaatgtggtgaaaaccctgtctctaataaaaatgtaaaaattagctgggcatggtggcgggcgcctgtagtcccagctactcaggaggctgaggcaggagaattgcttgaaccctggaggcggaggtagcagtgagtcgagatcgcgccactgcactccagcctgggtgacagagcaagactccgtctcgaaaaaaaaaaaaaacagtaagggggaatattggacaatacccccccaaaaatgtgcagaaatagccatatcagacgaaaccgaaattaaggcaaaaccgctgacgggttaagaggaactccgtatcggggggaaaaagacactcccccaagaagatgcagaaaccacactcggcctgttagctttcagtgcatcaaacaaagactcatggtgacaagggggtccatttgggggtcccagagcccactggggcctgcaggtcgggctgtccttggccactcctgggacccagagcccgggcatgtccagcaccccctccgccagcccgtgcgccacaggctctgctcttcaccagtgcagaggggtgcctcctgggggtgtccccgaccctgtcactgtgctgtggggatgggtagggggcagctctgggtggcctggtggcccacagtaggtagagaaggggggtggcccaggcccccgggacaggagccccacagtgcctgacccacttctccccgcagtcctcatcaccgggggcatcgtggccacagctgggcgcttcacccagtggtactttggtgcctactccatgtatccttccacctgaggctggggtgggcggggaacgcccagggcagagctggggagccacttcacagtgagctgtttgcctccgctccccaccaccgcagccaggctgggacacagggtgggctgtgcacgggttgggcagcccaggccccagcagccaggcccctcgccaggaccatgtggcgatcagcggcagacccgccagtctaagtcctggtgagtggtgggcagggggtgtcaccagagggccagggccagcactgaggcctccctgttggactgctgggatcccctctgcccgctcctgtcagtcatcccccttgaccggcccctctacctcctctgccccatctcagccctgccgcccagccggaccttgcgacaaggagcactgggcagggtggtgggagggagggcgtgggcagccccgagtgccagacctgttggaacctcccgtggctgcctcctggctctgtgacctcaggcagtggctgcccccgaccttttttgagacagggtctcgctctgtcccccaggctgcagtgcagtggtgcagctgtgactcatggcagcctccacctgggctcaggccaccctcttacctcagcctctggagtagctgggaccacaggcacacaccactgcacctggcttttaaattttttgtagagatgagggtctcactatgttgcccaggctggtctcaaactcctgggctccagtgatcctcccgcctcagcctcccaaaatgctgggattccaggcatgagccaccgtgctcgggcccctctctgtgttgtcttcagtaaagggagttccctgtggcccctcaggctgagctgggctgttccttaaccacatggcttcagtgtggcgggcgtgtttgtgtgcctgctggagtacccccgggggaagaggaagaagggctccaccatggagcgctggtgagtctcctcctgctctggggtctctccgggggttgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagcacatgaccgccgtggtgaagctgttcgggccctttaccaggaattactatgttcgggccgtcctgcatctcctgtgagtccccgtcccgcaccccctctagggctcaggagggcttggagccgaccctccccactgtcccaccggccgggctgcctggacaggagccacccccacttacctcagtgtttttccaaacaaaaattcgggtccctggctctggcagggcctgtgtctgctgtctagtgtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctccgagcaagtgcaccagagccgctagtgtccacatcaaggctgagaacacccaggaccgaaacaagccccggtccgcgcacgtcccctgggtctgcagtctgccttgtcctgagactttgtggccttggcccccagacctggggctccgttcccctttctgagtgcccttctgtgtccctgcctctcacccgctgtcccccaggctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaaactttagacactggggatgccttcatgctttctggtgagggtctgttaacttggcccgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccgccaggtgcacccacctgcaataaatgcagcgaagccgggagcgcgtgagcctctgcctggggccggtgggcggggctggggtagcgatggttcccgaggcctgggcaggcaccccgtttcctgccagccgggccgcattccagtttcattaacatcagcatcgccttccttctcagcagcacacgaaatcccgggtaccgtatattccacgaaatatagtacctggattccaggtgtgtgcctccctagaaaggtcctcccgggcctggaggaggcagcagagtcctcccttgacagctcctgcaggccctgcaggccctccacacctaacgcctccctaaggggcttggattccagaggaggccgctggcgttaagtgaaaagggaacagggtcggagccacgtggtgagcctctaccctgcgcctcttttccgtagaagctggggtgaagctggtggcggatgtggccttgtttgcccccacactgatgctggggggccccccagctgcccaggacgctcaggccaagttgcaggggcttctggccaccccttcccctcacttgtgcggaggctgtggctggctgcacacacacctgcccacaggtcctcaccaccaccccagcccggtgcccccaaagctttgcccggcgtcagccacgtcccccacctttgggctctcgccaaggcacccactcccctgaggccggagaagcccttgcctgctgcttgtccacctgctctcccagcaactcacacttcagagccagggtcctctgttcctgggggccttcagaatccaccccccaccagccaacactcggcaccatacagacgtctcaatccagcctcatctcagccgtccccccaggtcaccaagcttcaggtcacccttgaaacccccacacccccacatccaatcctggcccaaatccagaccccagctacatgggccatccccacccaggccacctgccgcctcccgctctgccctcatcccctgaaaccatcctgatgctgccattgaaacccaaagcctcaccccagtgcctccggctcagaatccgcaggctcagaacccacaggctcagctacctccagtgacagccacaagcttctgatggccccagggcagacatgatctgcacccccagcgccctgccctgcccctgcggtccccctctcacctggcatcagccacgcaggccactctctgacccttggacacacgcagcatgtgtcttctcagggcctttgcatgggctcttcctgctgcctggagctgttccctgcatggctgcctggctccttcctcctccccttcaggtcttcgaggcctccctgaccctctgcttagaactgcagccccttggccgggcgcggtggctcacgcctgtaatcccagcactttgggaggccgaggcgggcagatcatgaggtcaggagatcgagaccatcctggctaacacggtgaaaccccgtctctactaaaaatacaaaaaattagccgggcgtggtggcgggcgcctgtagtcccagctactcaggaggctgaggcaggagaatggcgtgaacccgggaggcggagcttgcagtgagccgagatcgcaccattgcactccagcctgggccagagcgagactcctcaaaaaaaaaaaaaagaactgcagcccctcccccagagcctctgtcctggactcactcacagactacacaccacttgtttcattagtcaccgtggaggcaggaagggttttcaccattttgttctcggcctgttcccagtgccaggtgcttagtagaaactcatatggctgggtgcggtggctcacgcctgtaatcccagcactctgggaggccgaggtgggaggatcacttgagctcaggagttcgagaccaacctggccaacatggcgaaaccccgcctccactaaaaatacaaatatgagttgggtgtggtggtgcacgcctgtactgggaagctgagctgggaggatcgcttgaactcagaaggtgggggtggcagtgagctgaagtca

SEQ ID NO: 11757 - DNA, 131631 bp, Human
  misc_feature (1)...(131631): n = A,T,C or G
tttccatacaaagtgccaggtcctctgaaagctccctatatcacctggccaattggaattttcacagccaaggcagaaaacaggtgaggtttggttgtcaatctccatcttaggcattgaacaggatgtgtagccagttcatggaagacctttttcactcttctgaagacttaggaataaaaaagggctcttactgttatcatgtggtcagaaggcattctttttccactttaaagaaccaaaacttcctccagttcagaaacagtaaatgaatggtccaccatgtgctgcgaactttgctgttcaccaccatggctgctcctagcagcatctatgcaagcaccccatggatgctatccagggtttcttctttttattattaatagctaacatttactgagtgcttactatatgccaggcactgtgcaaagggaaacacaatgcctcagtcccaggtagttcctgggaaactgaacagaatcttaaatagaaactctaaggagttagggaagtgagggctcactggggctgtgaccccaggggagaccacactcaaaagatggttttgcaactcaacctcagtttcaggcctgctatatcacttccactcactcagtagtaggcttggcatttagtgggggacagaggcatggtgggaagttgggggtgctgttcaggcttggccctcaccagcctctgctgggactggtagcatgaatgctgtgtaggatgttggggagctggaagaagactcttccgcagcccctccctctctatcccattcccctctcatctccccacccttcaaggttaaatattaaaaattcccttcacggggtgagctttcagtccttgattcactccaaacaggcttcaaacgcaaatagctgtagagaagattaacaaggttgcctcaaattatttggcaaggggtggggagaggatgcccaggaaccctggctggctggagagtggggagaaaagggggcacagtgggaagctgcaggcaaacacctgccattgtagcattgcagaaggccccaaaggacccagccaatgtgagacaggttggtttaaaagcctcccatgggaagaaacccagaatgatgacaagcagagccaagttcacgtccctgtgggtgagagtgtgggtctgggaatgtgaagcctggagcaggagtcaggggcaggggctctaggagagctgctccatgcccagaattgtgcagggaatggcataagcagtggcccagtcaacttgcttatcccaggcccccttttcccaaatttatgatttgaaaatgaattattttaaaatgtctctggaatcttgagtacagtctaacaaggcatttgaaatgtaaagatttatgtatttaggaaagcatgaggtaaattaccttcattgaaatatatacatagagagagtaccacagggagtaggattgtctcaaacaattccacatgtctgcttctcagggacctgtacccaccaccctgtccttccacaaagaatgtaactaaccaaaaaccctagttctgtagcaatgaccgcatttgagaacgaccccacaccccgcacttagttcaccatcatttctcttggcactgcaagaaggaggtcagaatgcagttatgttgcggggaggtcactgccacattgcagatcttttgctcataatgaagcttggcaagttaggctgggagacggcagggctgtctcatcggtgttggtttagtcgctatgggtggggccggctgggagggcaaagggcacagccatcccccatgcaattctgtaatggacagtaggatatgggggaagggtgtctcaccagaggagcaaggcagagcccagatcacagctgtcatgcctgagaacagtctgcgtttaacaaggagcaggcttgtggggccagaaggtcagatctggactctgatttttaggaaaaagcaaggatgggagagtgagtggggacaagaacaaaggaggaggctgagaggagagtttctctgtagtgggccacaggagcatgccaaagggtgagaggatggagcacttaccagactgcttatctgaaatgaggaaactcccttagataaagcaggaacgcggtggtgaaacctgaggtgcaagactccaggtttcaggaacccccaaagggtgtgggatggtggagaagctgtgactcaagtagcagctgtggaacactagtggccaacccaggggtggactatggggggtgggcggtgagttgctttggacagtgggcagagcggtggcagcttgaacaagaattcctgtctccagattgggctgggagtatggcaggattgagcacacaggtaactcagctgtcaggacctgatgagggccagggatggtaggggctggggacaggaggcaaagggtaagtggtttcattcattcaaaaatcactgcacaactgctgagcgctaccaacaccagcaggccagggataggaagatgagtaagacatggtccttactcttgagaggtttgtgattgctgtaggagatctagactggggaaaatagagactccagtgccttaagaaatttagtcaaactcatggtgctttgaaagtattagacaaaagcagctctctattctcatattttactccagtaatactctttagcttatgcatatcagatttatttacccattgatttttccactgaggcattgagcttttgaacattccaccttcaactcagctgtaagatgcacatagactttagttgccaataaaattggctggcaacctgggactgcttcaggtcagacaccaaggaggtggtacttctgttccattttatagtgttagccccagaccattgaagaaaaccaggactcagttgaataattactttgggggtcttaactgaacaactggttggagggcatgagggaaggtgagggcatttgagggtaggatggagacctggccagggcagagggagggggaaaggtgtttgggcccaggagacaaagcctgcatgggagaggctgccttctgcacagcagcgataccaatgtctgagctgtggctgcccaggagtgctgacgaggcccacacagcttcagaagtggcacttgtagcatgtgagacagcctggtgtgaagaagccccaaattcaagtgggctctgtttccgggccaattccaagcagacctgcctgatatgccagagaacacaggtatcaaggttcgcattgcgttagtaatgcctgtgggagacaatagggtgaaccccgcagcaatgtttagctttcttctcccttgactgaggagcctcggttgttttttcttaaaggatatattttccactgttttgactgggcttgtccaggggtgctgggaagaacaagataggcaagaagggaaggactaataaattttcttgctcattcctaaagtcctatttttagattagatttttagatcttgagctcatcactatgtgcactagctgtcattggataagtcatgtccaggtgggacacctggtggcggctccactcttgccaaccctgccctctattgatgccacccacctcacagatgaatgtgctgggtaggttcagccaaaagctctttcttttagaatcagcctcagcaagactagagtgacctcctgtcccctctagaggccatctagaggtatattctgaatctgctgtggctcacttctctcaagatctcctgggtcaggggtcaacttctcacctgtacttcagccaatgtatcctcctatgcttgggtccctgccttttatttctttatgggtgattttcatctgattgccttgctgcacaggtacaaagcaacagatctgcagaatgaaaacagctggggaaccctgagtggggtgagagtagaatggaggaggtggtggtatcttcttaagggggtactcatggtggaagggtcttcgtttttcttggggaggattccctttgtgctgtccaaggagacttccttacaccatgggctttggacatgcttggtagtcagggcacacttggctttgaaatgcaacgagctaagtggaataagcactttgtaccatactggctgatggtaccatactgtgggtcagataggaatcaaccttccaggggaaaagaacaaacaaacgaaacagacaaacaagtgcctgaagacagaaatttaattgagtgcttcctggcttttattttagcccccctcatctaaagatgtgcatctgtcccagatttgagctatgatgtgtggagaggtagaagagagaatatttatatgcaaataagaggtgttgaccagaactctggggatttgggtgaggaaggaagccaggttttctgtggcaggggtaaaaagagagagcaagggagagaaggggcgatccagcaggagagaggagtagagttgttatagatgacttctcctggagagttggatcaggcccattgcgggtgagagggcaaatctttcccaagaacccaagtggtagaatgggtctggccttccctttaggtggttattggagaactggtgggtatgcatgtggagacgcagatgcctgacaaagctggtgccgtctggatggggggcaagtaaggtgtttaggagtgagactgtggtgactggtaccaaaaaaagaatgttggggtgatcagatccaacaccaggccttggtggtgacgaagtctggcggagtcaaaggaatgagaaaacacagtttgagagagaaaacggatcaagtgggctaacgcaagtatggaggctgtgaaggccctgagctctggaagcccagactatttattggcgatcaaacaggtggtgagaatgtgggggtcgaaagggcaagtgcatgatctacagctgtgaaagtttagcatttcctttgaagcatatggaatatattctcctacttgagataatggggagcatgtttttccagtttaagctagaagcaaggagccagcaagtctagacccattccagaggccacgaggggttttatgcgccgagccctggacattatgtcagacatgcaaaccctgcctcagcttttttcccaacactcagctttttcccaacattttccccttctcttttttgtaaaaccgccacagctatcattattactagcataaaaggtggcctctttttgtttttaaattaattgagcaaggcaattgcaggctgtgcagcctttgattgccagttggtgatccaacttcattgttcttagcccttattcaaaatggagtcgctctggtttgaatgcttcccacgtatctcccctttcccttttacaagaggacccttaatcctaggggtttcaggatgaaggtccatgctgaatgggggcaatgatactcctgcctaactattagggtctcttgtattcagggtagagaggcactcagtcagaaagcattggtccgttaagcatctgtaggtaaaaccctggcgctccagcagtttctcagcttcctgtgcggttttcttgatctgtccccatgttatggggattgcacccacacggttcgttcatctccatgaggtagaactttccactgataatgagaaacaggccccttctaatagaaggcacagagaaagcaaatggaggcttctcaaaccttcaatttgcactgtacaggtgggtccgctagatgctgtggctcatgatagatcttcagatgtttggtgggcacccacacaggcacctgattgtcacctggagagacacaagcaaatcttcttccccatataattatctttcctttttcccagctctttgtatgtgcattcctccaccatgtatcttgtccagcctttttattttccttttgtcctgttaggtgttgtttcactgcagttatgggttgatctttttgtaaatttaaaaattttaatgttaataaagctaaatgcaattacatatgcagtgtcttatattcctggtccttctccaagtcgatatcccatatttctcatcatttgtctactattattactatattgatccataggaatagatatttcagcatcccattgttgcaataagtctcttccccataaattgacaggaataggtgtaataatagactgaattgtcccttcctggccatccagtccttgacatggtaaaatcaaggaactgtgaaaaacctctgaggcggttcctacgccaatgatacccatggaagccttttgtttgggccagtgtcggggtcattgatttagagcaataatagagacatcagctccagtatctactagtccttcaaaatcctttccctaaatagtcactatgcaaataggtcttttgtcagacacttgattaacccaatatacagcctttcctgcaggattagtactaccaaagtcgcctgttctttcactgtgctgcttcctagttttgtttagggtagcagcagcaactgagcaattctttctcctggggaggcagaccacagagttgaggaactaataactaattgaatttctctggtataatcagagtcaattattcctgtatgcacagcaacacctttcaaatttagactagaccttccaagtaatagaccaactgttcctgagggtaagcgtcctctaactcccgtagggaccttttttggcagctccccaggaaacagggagatggtaattgtgctgcaaaggtctatggcaacactgcctgctgtggcaggggacaattgttgtacgcttgtgagggcactggctgtgccgggtatgcctcggtttgttgaggggcctgaggtgggccactcttcccatttcctgaaagaggttgtccatctttagaacgacactgatttgcccagtgattgccttttttacaatgggggcatacaccagggcttttctgttgattgacggtagtagttcttgccttttgatttccttttctacattccttttttgtgtccaaattgccgacaattggaacaagagcctgagaaatggggcatattctttcctactcttaatccagccatagcctgagctgaaagagtagccttatgtaagttacctccaatgccatcgcaagccttaacgtattcagagtaatggcttgcttgaattccttccctccttgctggattatagtaatgggaaattgccatacttcaaggtctccctcggctctagctttttgaatagaattttgtatagcaccaccaattgctccaggttttaatgttgcaactacaggagtggtgtttttcagctaattcattttctcgcccattaatgggagagagaagaggtggccattcacttaattcagcaggtggagccaacgggctagtaaaacatacttctttcagtttccctttctttaatttcctccggtttctgttcctcacattcagaatctgaaattagttctttacactcgtcctcctcttcctcatctgaatctacctcatcatctgtttgaaatggctcaaaagctgcctttattatcactcacattgaccaaaaaaaactggaatttttgctccatctttatacgcctttttaaaatctctgccaattatctcccattcatccaactccatagtcccttgttccaggaaccatgggcaaaactcctttaccgtactaaagagtgataacaaattctgagtactaactttcacccccactcttcataataaatgccttaagaaacttaaataagcagaatatttgctttcactttgtcctgttgttaccctggttcttccgagccctcagctttcccaccaagcttcctttagtcatccttgggtgtcctttgacaatgcatcccctgctttcacatgctctagtgttccttcaccagggcctttgtcgccccacgttgggcagccaggaatgttggggtgatcagatccaacaccaggccttggggcaacgaagtctggcagagtcaaaggaaagagaaaagacagtttgagagagaaagtgggtccaggtggccaacgcaagtatggaggctgtgaaggccctgagctctggaagcccagactatttattggtggtcaaacaaagaaacaggtggtgagaatgtgtgggtcaaaagggcaagcacatgatctacagctgtgatagtttagcatttcctttgaagcatatggaacatattctgctacttgagataatagggagcatgttcttccagtttaagctagaagcaaggagccagcaagtctagactcattccagaggccacgaggggttttatgcactgagccctggacattatgtcagacatgcaagccctgcctcagctttttttcccaacactcagctttttcccaacaagaagatgaagtgttgtatcttaggggctccatctacaaggatgaagtaagaccggagaaaggggtgaaatcagcaagggtaactatcatcatgtgtctggaggtctgctgctcctttactccagcctctctgtctcagttcttctcattccagaggtccctgtggactgtgacaaggatttttcagaattcagagagggaaccaacaaggggcaagcttggtttatttctctttatttggtttattctcattattatttttcttgccttttctacctctaattccttcttagcccttccctttctgcttccatttctatcccaaaatatgagccacaaagagaaatttggggaattagaaggaagagacttaagggaaaatgtatatgtcattggtgtatgtgtcagttttcagtcataacttgggttgggggaagtcagtgtaccctttactcttgctgaggaaatttcttctgagccttagccacatcccacttgcccagggcatcattcttttcttttttttttctggcatatatctctacttcagattcaaacttggccattacctctggccagccaagcagctgtcccctgagaggggggccaactctcctgcccctcactgcctgcctcccaaggctgccctagggctcagctgaagaaggcggttgtgctttgctgccccctgttgctcaagtcctgcttttccataggagctgccgggctgtatgtctggatgtgacttctccaggcaggtcctcctctcctgcccgcagtgctctggctcctcagggtaggtttctgtccaggacatggcccctgaaagggcttggaaaaagcccccttgcgtagtactggctgagcttctacttgctgccccaggaacctccagagagtgacccaaacatctggtatagcctctaatcttacctagtcagtcatgtttctcttcaggcctcttctaagaacagtttcctggagaaacagaatagagttgtggtcactacactggagtcttcctggggtaggagtgggtcctttctaaagtagaaggggctgtgtagcaagggggctgtgtgagcatttctagaaatgttgtctgctgaattttccactgggaaagagcaagtcctggcggagttagcagcagctgggcagtaggcaatagatagcatcagggtctctggatgctcagtgggggtggcatcagggaacactggtttccccagtaacgggcgcctgggcctgcagtggcagtcaattccacagaggatgccccggagcttggcatctctcactgtgctgtcttcccattcctgagactggaatatggagctcatgtgggctgggcagcttcccagcagtggttggtcaggatgtgagagtgctgtggtccaggtacctgtggacaagtgacctgccacactgcaagacccaaaatgacactggactacattcgttgacacagttacagctgtaccaaaattttttttccaaggttcaagttggaacatttgtaagccaagccctcatgggtccaagcctattttcttcaccacaccacactgagtgagggcagtggctcattacagaccacagtatctccccacctccacccatgtagatgagaacctggagcctgccaaggactagtgtccagaatggtgcccaagtcacctcctgataggtaggaagtggccaaaatgaggtgtaggacctcatgtcctagaggtcaaagctaagagtccaaggcaaatggccacaaggcagaaagagccaaaccagagcccccctaaaatggggagaccaggatggatagataagaagaagggcaggctttggctgggcgtggtggctcacacctgtaatcccagccctttgggaggccaaggggggtggatcacgaggtcaggagatcaagaccatcctggctaagactgtgaaaccccgtctctactaaaaaatacaaaaaaaattagccgggcatggtggcgggcgcctgtagtcccagctactctggaggcggaggcagaggttgcagtgagccgagatcgtgccactgcactccagcctgggcgacagagcgagactccgtctcaaaaaaaaaaaaaaaaaaaaaagaagggcaggcttttagttttagatctaagtccaaagtacaaatgtgagcagagcgggctcttatggagggagccagtcacatggggtctaggatggagtaacagttcaacccccttagacccatcccttctctctctgtttctcctttgacttcgaagttaacaaaaacatttaatcgcattctaaatgcaaaagccccatgcaaacacttggaattgggaaaagaggagaatacaacagtttctgccctcaaggaacataaagtgagttcacagcctctttctctttcagcctcctcttttctctctcattccttcacctagcaggtgctaggcagcaactgtatacccagacattattatttctcttgccttttccacctttaattccctattagccctttctgcttccatttctatcccaaaatataagccacaaagagaaatttggggaattagaaggaagagactttaagggaaatgtatatgtcatcggtgcatgtgtcagttttcactcatagcttggtttgggggaagtcagtgtttttttcctcttgctgaggaaatttcttctgagccttagccacatcccacttgcccaggtcttcattcttttctttttttctggcatatatctctacttcaaattcaagttggttgtgggtcttccacctactttgtagatggagatgtgggggttgatgccaatctgacagtgaccagcactacagagtggaatgggaaccttctcatcttcctgctgggctcccatcccagcccccaggcctcaccttgcctctcctgcgcagtggggttcattccaggatgccctcccaataaagctgagggcatgaaggcttcttgaatggcaagcactttggaggctaggaagggaacaaatctttaaatcactaggtactctttttacttctcatcttgcttttaatccaagtctttggtctcttacttgcttgctttcttctcacccaggacagagtcacagagaccttgaagaatggaggaggtagaaaaaggagaaatgcaggaaggaggtgtgttatggagttatccagtggaggctcgcatccagctttattttgcctccaaagatcttgcatcctacctgttaagaagcttggaatgccactattccattaaatcttaaaggaacttgagtctttcatttaaaaatgtgttcctaaaatgtaaatgtccctatgtgggacagtatttagccgacagtaaatttgagaggagggtctcaaggggcagtgtcaccaggaaaagagagaaaggctcctctccccaagtcaaaccttaccttacttaaccgattgtatttcctccctcagaggatgccatatctcagtacaggagagaaaatagaaggtagagagacttttacccaagcaccccctgaaccccaggtgtacacaactgaacctgatgcagtgacaatcacgttcacacataaaacatctggctaaaggctaagatcacttcggatttccgacatacattttcctaagcagtgcatttttctttaattttccttagaaaaagactgtaaagtagccccacaattcccacatcttcatactccaccctgcattcaagttttcctgggacaggtatctatgtgtgtgcatgaatctatttttacggcatatgtctaggaccccctacgaggagccaaagtttcagagagcccagcaactatgtaactccatggaagggaggcatgatattactctctgttcacaggagcgtacgcacagatcttttctcctcctcatggtcagttttctatttgtgattagtaattagcttctcttggtacgctacgatctattacaaaagccaaacattcagggggcgagctgaaatgacaaaatttggctataatttatgttggcccctgacatatatatttttttaatggtttggtctctaagcaactgatctcttagcaacaagaagcacctttataaaagatggcacacgaagagtgattgccagaaaagccacctggttcttaaacagccgcgcatcattagcaaaactcaccatcttcaagagtccaaaaactagaagtgaccagcagacccaggtaaccttgatatttgcacattttcctggggaaaaaaaaaaaaaaaaaaaaaaactcatgcaactattgaagagaacaaaattctttgaaatatgttcatttttgaggtcttattagttggtcttgactaacttttaataatagtatgtattcttttaaataactgctttttgatttttttaaaaaaacgtgatatttgtgatcagaaaacagttcacttgaaatatttcattggcatgagaatggaaggaggggaacaatctatctgtttcagaatttatttctgtaggttttcatttgatgggaaaaaaatccacatcatggcaaaaataggagtatacagaatgtcacccaagtggtgtgcactattagggaaatacgcgtatttattttctaatttattttcatactgcttaaatatttaaagagtagcaaaataattttactttcaaactttagctttttaatccaatgtcaattccagtagaaagtgatagtcttttgttgcaagtgttcaaggactggttttttcatttgctttcattgccgtaagaaaagattcgttccaaaactaaaaataggaaaaattacaggcatctgtaccttgtttgcttttttcaggtacccagggattgaagacttaaatgtctttccagaaaattggaattagaaatgagaattgttacttcatctgtactccttcaataaagattgcgtaattataaacccacttggggcactcaaagggcataaaaaaggagatattttatggggatgaaataaaaatcctcctaattgagcttggaaacagtgttacacagagatactgcagatctaagaaaacagactagaaaattgcagtttcaataaagacaagttgaaatagtgacacatagttttattttttataagaactgcttgtaccactttctctctttttctttctttatttcttttttctttctttctctttctctctctctctttttttttgtgccctttcagaggtgcaaatacctctttaaattgaactgtatgctgacattctcttggaaccagaaaatgggatgctttgtctgaatacaaagcttggtaatgggtcagggcattcaaaaccaacacaatcccacaaattttgggacttacagttgctcctctaagcaaaggcacctcaatagcacattatgattacgtttgattttaaaagctgcttatgacttgtatttctgttactgctaccgacttcaggcaggaagaattcatttttgtggagactttgcttgaagttagaaagttgggtgttttagattgaattgcagaaattttttaaagcaatgcactatgaaatcacagagaagcatataggtttgtccttcagaactaaaattgtatgtacttgcagtgtggtaattactgtagaaatggtttgtggctttaaagttaaggaacttgcataaataattacaagatgtaacttgtgtttgctatgtctggatatgttttcagttttaactgtactgtagtttcctaaaatatgaagggtagttaacatgaaagcaaaggtatggtaacatttatattgcaagtggcagctaagtttttgcagtggttctttgggactttgcaaatcgagtcactgtgtctttcgagttcatgtgttctgagttttatctatacatgaggaaacaagggggtcagtgggcctgtagagcttgtcattttggctggcataatgagccatctgacgaagatggacaaactcctgcaagatgtgagatagactatgaaatactctgattagactggctgctatagactaagccaaatcattctgctgtgttaggattagttatttctgagacacgcacttacattcacacacatgcctgcatataaatggtctcaatataaatctggaaatcaaaacaagcctctctatcagtgagagcttcctaggaaaaaggatagttttaattttgtgaaggacagtttccatcataatcttcatttagcgtctaaaagtcctagacaaacttgacggcccttttccttcaaacctcaggctggaatctggtgtggggctggccggggggacacagcagctagcaggcacactgtcaagcagtcctgctgtaggggcgatctatgttacgaatgaatccatttactttggacactttactacctgaacggaaacaatcaggcaggaacttgttcaataactacatggttggcctttcagcagaatttttgaactcttataaataaaccatacttgggataatttagtctttctctggtgagaaggaaacaagaaaaaaaaatgtgagcagtcactcttgagttaggtgcttgacgaggactgggcaatttacaacgtgcagttttgcttaacctttacagcaactgtccagaagtctccgtgtccccatttcacacatgcctaagccagatccagcagtttgccagatgttacctaaacagtaaatggcaaagttgggatttcaacccaggacagtctgactcccaagcctgtgcattttccttgtgtcagaatggcacaagtagcaatttaaaactgacactaaataatccctctggtcttagtaaagcaaaagctctgagtagggctggaggtgaagatttaggcatcttttcacagaagagactccttaaccactggttctgttgggtggagtgactcaggtcctgtgttttcaaggctgccattggctatgagccagaggtgggtgctcatttaggctgtggccgtggtggccacaggccatggcaccatttcttgccatgatgcacatcccaagtgaagtggggtaggactctttgaggttccctttctgtgtgaacagttctgagaacagggcttcctggatgtcccctcccaccctgacacgggccacaacagttagggactgcacaagcagagtggaagccaaaccacaagcggagcggaagccaaatccagaatgggccaagtgacatgtcaccaagttaaggtgaaggagggagagcccaggtgtggctggggcaggcctgagagtgggggtgagatgacaatagagaaagcagagctttctccccagcgttgcaggatttcggtatgctgtcccctctggcttatggtgttgccccttctttcttcttcaaatacccctgacaaagggatcaatcttagagagtttattaaaaaaaaatcttcttctaaatagtatttgggcaggagatgatgtatacaggagcgagggccagggaggctgtagccagtcctagaataaacactctgtgcatctctatttcttgtgatccttccatcactcagacacctggagcatcgtgcctaaagccagacagttcatgtaggtgggatttaaactcaagtcttttggctagaaacactgtggctctttcatacaactgggaaatatgatggtatttgtaggcagatacagattctgaggtggtctgccttgcatttggcatgaccatcaagtgaatacgaagagagctcttcacctgttacacttcagttcatcctcagaggagggaataacgctcccaagaggcataagaggcaacctcccatttctttttccattccctccccactcagggatatctatgggtaattcctctagtcatgagtcagagggctgatgggcagctcaggaagtctgaaaagaatgcccagtaataggttcaatttttgtacaaaaatcggtaataatccttgtgcaagtaatcttcatgcctctacttccctagggtccttgtctccaaacagacatgttcaccctgcttgagttcttgcctggtgtgtggtactattgatgtatatggctggcacattgacaccacacacctgccgtggacagcacgtgcccagtcccactctctacctggtgcaaaggaagtctccttttatctggcaattctgggtagaagaagagggccacttatgtcttttgtgtgtgtgtgtgtgtgtgacaaaatttcactctgtggcccaggctggagtgcaatggcatgatcttggcttactgcaacctccgtctctcgggttcaagcaattctccagcctcagcctcccaagtagcagggattacaggcgcctgccaccatgcccggctaattttttgtatttttaatagagatggggttttgctatgttggccaggctattctcaaattcctgacctcaggtgatccacccaccttggcctcccaaagtgctgggattacaggcatgagccattgcagccggctgtcattttttaaaaagcatagcattcttactctgggaactgacttagaggttgcttagtttggacttctcggaggtgaggggcctgagttgaagtgattttcccaagggctgtgcagctaggcaaaggtgggatagagctcagttctcttgactcccattccagtgctctttcctctgtaccataatagttgctattcctaagaagagggtgagagtagactattacccttattttacagatagaaaaactaaaggcatagttagattagggataactgccactccaaaactatgaaagttattaaatctatgagagtgatttaactaactgcttccctggattaaaaatttttattttgcctgctgaatataaacatgtaaggttcagtgttaaaatgaacacatcagagtgtccaaacactattctgcctattgatcatatagtttctctcctgtataaaaagtgaggaagggggtcgggtgtggtggctcatgcttgtaatcccagcattttgggaggccgaggtgggtggatcaggaggtccagagttcgagaccagcctggccaacatggtgaaaccctgtctctacaaaaattagctgggtgtggtaacgtgcacctgtagtcccagctactcaggaggctgaggcaggagaactgcttgaaaccagaagggcggaggttgcagtgagcccgagatcatgccactgcactctagcctgggcgaaagagtgaaactccatctcaaaaaaaaaagtgaggaaagaaatggaaaaatggtccctcccattatgaagcctgttgtcctaaccgagtatgcatttatggaatccctgaaaaagacgaatcagtgtatatctgcatatctgtctatctcaactgtcacagccaaactccacaccaaaaatcataaccaggggcattgtaagcagtggtccttgtggatttttctcctgctgggccagttttttcccctataataattacaaacttcatacatgagtttggtactactctagaggaggctctagcaaaactaccctgctgtagaggagcaattataggaactctgcaattctgatgacagttctaaaaacataatgtgaaggtacgaactcattaatatacagttctctgtgccaggttctgtgctaagaccttcatgtagcttttcttatttagtgttcactacctatgatgtcgatattctgagcaccattttccagatgaggaagctcaaactcttctgccaatgaggccaacaccatagagtggtgtttgtttataaaatgtatattttattgcactcaaacgatgtacctggcactggtctagatgctggtgctataaagttaaataagacatgatccttgtcttgaagaagctcatagcctaatgaagctcatttccagttacatttgagaacttctgctctttggggctagtctaatagcacacaagagatttactcaggaacacgtatcttgaaggttgggaagggttggagaagaaatacgaggataggaaaagatatggctgaggttaaaactgaagggaaaaatcgaagatggacagaaagttggcactcacggtgtgtagaatacaatgggcacaagcatggatgagagagtgctgggttgtgcaaaagtgtcagccagcctggtgtttctctcttggatgaaggagttccacactgaggcacaatataaacaatgaacttggtgatataggacaatagtagaaaatcctaaaaaccaagcaaaggagtttggatgtagtgaacagataacgaagaactggtacaaaatctgctgatgcaaacactgctggctttttaatatcaccagattgtgaacacctattatgtaaaaagtgccagaggaaaagatttttgtcaaagtaacattgaccctgatggggggataatatgaactagaagatcagtctttggaaatccttggactaatcaatcaaagagtggcagtagccacagaggatacagcctgacctcagactaattcagagaaaacaatgggcttgactcagtgagtagatatgggagaagagaagaaggaaagaaaaccaaaaggatggtgggatccctagaactaaagagaagtctaaggcttagctacctggttaggtagaactgtggtggagctagtttgtcaacaaggtttagatcttgtaaattgtccacccaagtgagagtattccttggagatgttaaatatgtcacccaaactataaatcaagacacgttgggtctcagaaaagatgtactcttctgagagtacaggaagacaggggaacgatctggaaaacatcatttggatgctaaactattagaaatttcaaggtgttataattttttatgggtacattagggttaactgggtagtcagaactttaggtgactcgcaggcctggttagaggggtattgctcccacaggtgcttgaaagagcatctctaagaatgagagagggacagaacagaagatctggagaccacagactgtatgacctgggtgattaagaagagggcgataaaaaagaatcaggacagagtatgaataagaagtgaacagagatgtgagaagagaaccagaaacaaactgagccacgtggttccaaggagacgttctctgcaaaggcagcagagaagtaaaaaaaaaaatgcttagacttgcacatagttcatcagacagggtgagagggaggccactgataccctcagaaagcaatttgggaggaacaggaacctaggaaaccagactgggtggcagttgttgtgggggtggaatcccagagcctagtcaggcctccagacccacagggccacgtgctgaatgaacacaagacagtcggtctaaagacttgggcctcagcagaaacccattttggaatctgtctgcctgtgtagcctggggatagtcagcttgcggtgggaggaaagagcatgaactctagagtcagacggatggattttggtctttcctcagaaagaaaccaactgttgagaccctgtcaaagagatttaatctctacttcttcatctttaaaatggagctacttctacttatctcacacagtggtttccttttttaattttaaagactcaaatgagataagatgcctataaaatatgggggaggtgttcagtaaataccaatttccctagaacagtggctggttatactgtgttacttggagtatgagatttcttcagcaacttctagaagctgtttttagggtgaaggggttccaggtagggatagggatactgattggaggagctccagctacccacatcccagttttaccagagcaccgggatcccccaaaagcttttgcttaaggcggtaggggaggaagcagagaccaaactactgggactagtaatgaattcagcaaggtttcagttcaggatacaaggttagcatacaaaatccaattgtattcttatatactctcagcagtcaattggaacataaaaaatttaaaacaatttcaacacagtagtaccaaaaaaaaaaccaaagaatacttaggaataaatctaaagaaagatgtctaagacctctacaccagaaattacaaaacattactgagagaaattgtaaaggacctaaatatatggtgagatatatcacgttcgtggataattggctgtattgatctatagagccagtaaacttccatttaaaatttcagcagactttttggggtagaatttcagtgtgtgtttgttaggaacctttaagaagcagttggcaagactgcattaaacatacaagaggtttacaggggcaaatgactgggaaagataaaaagggagggagcgggagtaggccaaaaagctttcagtccccagtgtagtctggaatctgtgaaagaagagagggaagggcgagttgtgtggaaagggcttcagacaacagtatagctctgagacagtttcagtcagcagtagggaacccccaagcaaagattgcctgttggaagagtcctgccttggctggaatgggctaccactagtacccttagcatgcttgtcattgtttaggagctacccagagaaatatggcctttctgtgaacatggtggtgaatccatagggtggaactgtcaactatgctccaaatagtagtagtagtggtagttgttgttgttttaaggagatttgagcagtccacctccatggcaaccccataaagtaatttaaaaaaaaaagaaccaagttggagagctcatcctccaatttactaatcttgcttttatatttcaagacctactatagctatagtaatcaaaatagttttgtgttggcaaaaaataaacatatagattaatggaacagaacagaaaatccagaaatagacccatgcatatattgccaatttttaataaaagtactaagacaattcaatttgaggggggaaaagggccttttcaaaaaaacggtgctggatatatccataagaaagaaaaaataataaccctattaacccttacctcataccatatacaaaatttaactcaaaatggatcatagacctacatataaaacctaaaactattacacttacagaagaaaagaggaggtgaccttggagtagacaaaggtctctcagaacacaaaaaaagtaggagccataaagacacttgacaaacttgatcaaaaatttaaaacttaatcctcaatagacacaaagaaaataaagcagagcacagactaagataaagtattcaaaacaacacgtatcagacaactcgaatccagaatatatatatattaaaaaagtcaataagacaaccccatttttttaaatgggaaaaaagatttggccagatgcttcataaaagatatatgaatggccagtaagttcatttgaaaatgctcaaaattattaataatcaggaaaatgcaaattaagatcgcaatcagatacctctagaatggctaaaattcaaagactgagaatgtgaagcaactgtaactctcatatactgctgatgggaatgcagtggaacctcggaagataatttggcagtttcttaaaaagttaaatatacacctgctatacagccactgttagatttttactcaagagaagtgaaatatatgtccacacaaagacttgtgcactgacatccatcatagccttgcttgaaacagccaaaaaaaaagggggggggggaaggaaacgatggaaatgctccttaagaagtgaatgggtaaactgtggcatagctatgcaattgagtactgctcagcaatgttaaggaacaaactattgatatgaacaataagaatgaaactcaaaatcaatatgctaagtaaaagaagccagatgaaaaagagtacagactgtttgattatgacaatagaattccagaaagcacgaactgatcaataatgacagggagcaaatcagtggttatcaggggatgggtgtggaggaaggatgggtgacaagtgggtgatggaaattaaatgccaccttgattttgtaatggtttcacaagtgcatgtgtatatgttagagctcataaaatagtacactttaaatatttgaggtttattgcatgttacttatgctttggcgaagtcctttaaatgggatgggggagggtgggtctgatggaaggaaagcaaccccacctctacagtaaaaagatttgacacgtgctctggaggaaacctaggggaaagtgatatggtactttgctttcatatttatctacttagtatctgcttcttccccagggtggggaggggcgaaggcggagcaatgcctagtgccaaccagttgtggcgttcaggctccttccagtgctctcgcctgctaagctggggtgggcacagggaagacccttccccggggcatggggagccggcagggctggtttcaatggcaatccgccatagggtcccgcgctcagaaggggtcccgcttggaatctaatgaatgctctgcagtcaccatatgaaattcttaatcatttttccttcaaattcgtgtattgtaagtgaagtgcaataacacagtggatgcttgagagcttggactcttgtctcaccccggtcgcgtctcctgcgtcttcctgggacaggttctgggcccccacccggcgaacaccgctgccctccgccctgggcagtggccggccacggacgtgggggcggcgcagacctcggcgtacagccaagggacctcgccgccacgctgggtcgcctgtgagggtcggcctttggcccgccagcgtccctgtgctcaagccagcgcaacttaactagcaaataaaccctgccgagacaggtggacagaaagaccacgggagaaagggaaaggctttttcctgctttttgaacgcggggccccgcgtttttattttgcactgggccgcgcagattctgcgggcggcaccgaccgcaggcagccggctggagaccgctcgccgcaccccctgcctcgcctagtgcccgagctgctccagctgtgaatgggacacaatacgaggagctggttttgctcctgaaagcgtccaacaaaaatctggctcgattcgccctgcttgggagtgacagagacccaatctttgtcatgaaaagcaggaaacgggagggcagctttgctctccagagcagggaatgtgtctgggtagaagcagggaaagttcctgcccacctcagattttcttctggatgcagactgccctgttctttgacttcctctccagtgtggaataaggctgagggtctcaatttggtgaaaaaagtaaccatgacaacagtcacatcgtggagagcatagtaaaatgtgtaaagctcactggcaatgccttcccttccagaatgaaagctcctctagtcagacaacgactcaacggcaccaaaagagcggaagggaagaccagaccagggaaggctttccgtgccctgccctggggccttccacagattaggggacctccgtgatttgtcagctctttgcctccagctttctcacacggtccggggctgctttcgagagcttatactaaaagggcaagagcagagatgagctgtttttaggaaacatgtgctacaaatgaagtaaacccatggaatttcaaaataaaaataaacttggaaagttccactaaaaggcttagggcctgatagaaattgtgcaggaatcctcgactccgaggtttgaagaaggactggcagaagcttgtccaccttcgtctagatgaggagggaggtgcttctcttcctgccacaggggaggcttcccactcagtcctccttccataggcaggacgaagcaatcgcatctttagggggcactggttggaatgagagacaggtggcctgggctccaaactctgtcactaattagctgtgggaccttgggtacatagtttaacctcttaggatgctccagtgcttgccctgctctgtccgtggagatgcaagtgccttgcaaggagaggaatgtgtcatgtacataatgtgatttgtaggcacacatcctcatgtgttcatttctctttgctcttctcccagcctggcagagtagggttgattggatctggaagctttttgtgaggtgagagcaaaatctttcctcagttggctctgggctgcacagctggggagactttgggagagaacagaagcttcttttacctttgtgcaaaggaagccagccatttccctcaaggttggcggaagctagatttgctatgtttctggagctatcactagatttatccagaccaggcatatcctctagcctgtagcctgactggctcagtgggcatccagggatccgaatgaagctcaaacagctaaaaagggcaggcagataacgaccagagtataataaactgtgggggaacggttggcactgaggagagcggagagcccctgccctgtggaaagagggcagtccttgcttggggacagctggttgttgccacaaggtaatgtgattcctctagagccagatctgatttttttcttaaaagaggcctgtaatctggactttaagatatccaaaattttaaataaagacaacgaaagcaaatgtaaaactcagtataagccaaaagaagacaggtgagcaggtcgagtgggtgaatgataggaaactgcagtcaggactgggaaatctgagagcaatgcacttttgcctgggttcccacagagagccctaacaggagcaccctgcctccctcagcctgtcttcctccctccgggctgaggagactttctatctgtccccatcccttttgttcaagccaatattgtggccaatccttgcctaacttttatgggatctggattttgaaactcaaaatatttattttttccatctgctttctgcttcccttaggcaatgaaaaatgctcagctgacttaatgtggggagggagtaaagggcaaacaggtcaacatctcagagggaagggaggacatggaacgctgtctgacctgcccgcagccaggggaggtgggatccagaatggcaggctatactgggtggaggaatgccacacacatagccttggaggcccaaacggggcagtgtgcttgggaagttaggcccagtttgatagagctgcatggagcgcagggcaagtggcaggggatgagactggaaaagtggatgaaataggatttatgtaacataagaaagtgtaattggctcaaatgtctgattacttatgtgttatttttgtaaagctggtgacccaaccctacattggttttgtataatttaacatctgtgcactttgaagtgacatacattgaagaaccttcagagtgtcagaaaccatgacctggaaagcacatctatcctaatttgggggtggtcttgatctctatgaagtatccaaactgatactgattggactcatttgaggatatcaagtaacatcagacttcactgagaggtgtgccaccgctgtaaccaagggactgctactactttctgcctgcaccccaccccagttcctattccctgtttccccagctgcatccaactcttcttgttccccggtgatccttccaactctttctcttcactatattggggctggcccctgaagactccattttttccttctgccctgcgttttcaataataaattctataatttcagtgctgggagctggtgttagtgtcttccaggcaactcactgctgtcccttgaccgtcgttactctttccttctaaaagactgaaatctcctgtaaggttcacttcacactatccaccaattcaccctgtctcccctactaaccaaaggctttggtatctttctcggggtcttaccctcccccccgactcctgccatcattctaagtaactgaatgtccttgtggctgatccaaccaatgccctgactacccagttccatgatgactgcaccgtcagtgatgttatttgccctttcacctcagcacactcacatggacacagcggtgaacctgtcatcatcagaaactgtgcctcctctgaaatctcattctcttgccaccaccctccagctcccttgctcaagtcccttctctacagcagttctccagcctcaatgagatttccaagccaatggtccctccactttgcctatgtccataaatctcctcctatcttcattttcttttgtatctagctcagaggccatggttcttcctacagtgtcctaaaaataccactaaatcctttgttgacctctcagttgttcccagatttactcatgcctgttgcctgaacagatcagaattactggagaatgtgacacaactgggcattttggcatggctccaacttcatgctctccaaactcagctgggacctccacactgcctagcaggtttactgtgcttttctagaagctccctccatgttcacaatcacaatctcatttcttcctctcagagttggaatgcttgcaacccctttattcccagagcagcagcctgggaggattggatgggtccattggatttgctcctgtcctctcctttcatcactgcctccagcaaagtacagtccctccacaggtgcctggatctcatgccttcctccctggtcagggctcttgttctgtcagctataccctctcttttccaaatctttgacctcttcctcactactggatttttcccttcagcactcaaatatatgcaagaatccaccctcacaaacaaagccaagcaagtgaaaacttccctaactccacacctctgtcaagttatcacccattctgtctattctcctttaacagccacgctttttgaccattatgcataggcactgcctctactttatctcctcctctcctttccattctggcttcctgcttcaccacattgcagaaactgctcttgtcgtggtcaccagtttatccaatgtcaatgttctgcctgcatctgacttgaccactcagcagccctttatacagttaaccatatcttccttcttgaaacactctctcttccgcttcagtgataaaataggggttttttgtttgttttatttacaccttatgacagttctttctgaggattttttttttgtctgttccttttcctaccaaattctaaattcttgagttctttgggagttcatatcacaacatattctgccttgcaatttcagcttctctcaagaccttaaataccatctctacagtggccaaatttaggtccctggtttaatctttcttgaaatcttaacttttccattacagaactgaaattaagtacttatttgggtgattatctatattttgcttgtctcccctcctagactataggctccaggagtgcaagcattgtcttttttttattcaccacttccataatctgttgagtcagcttcaatgtcaattcctacccaatgggttcatgctctgtctgccaaaggccaaagcaagtatcatgaaattttctaagagctaggacatgtcactgcagccttttctccaaatttaagtgtgcaactatattttctttattgcagaacaggaagtcaagtagtttcttttgccagaaatggggaaatcgtatatcaataaccctagcactgggggagtgaggaggcctcaagtctgtgagtccaggcatgacatggcaaactctatagattttggaagactaactgtcagcagtaaggaagaaaaattggtaggaggagagaataggggcagggttatttgttgtgattctgtttcaagagagggctgatgaaagctcatggatggccttgagaatagagagtgctgagaccacctcagctggggagaccctaacccagtgcgctagaggaattaaagacacacacacagaaatatagcatgtggagtgggaaatcaggggtctcacagccttcagagctgagagccctgaacagagatttacccacatatttattgacagcaagccagtgataagtattgtttctatagaatatagatttactaaaagtattccttacagaaacaaagggatgggctctggctagttatctgcagcaggaacatgtccttaaggcacagatcgctcatgctattgtttgtggcttaggaacgcctttaagtggttttctgccctgggtgggccaggtgttccttgccctcatttcagtaaacccacaaccttcagcatgggcattatggccatgaccaacatgtcacaatgctgcagagattttgtttatggccagttttggggccagtttatggccagatttgggggcctgttcccaacagagaggaaaggggaaaggagggactttcagagatgaaataacaattgattgggggagagatggtgggcagtgagaagtggcccagaacctgaagactctactgcttcacccatcggcctctccaatgggccctcacttgcatgctattcttactccctgggaggacctgccccacacttctctccttggaattctattcctccaccatgacctctctgaaactctccttgactaccctgcgaaagtaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccaagatggtggttggccactcccaagatggttgtgggccactccccaagatggtggcaagccttttgttctctgacctggggttcttggcctcacagattccaaggaatggaaccttgggccatgcggtgagtgttatagctctattagaagccgtgggtcatggaagagaaccgtggaacccagcaactagtgttcagctcgattaggctgaacctgagcacttagccatgcaggaacaatggcgagcctctagcccgatcaggagtggcgatgggcacctcgctggatcagaaggtcagtggacaccctgctggatccggagaggtgggagtcaatggtgggtctgtgatggtggcattcagcagtggtggactgtgaatgaaagctcagctcgagccagaacaaacacggaccagaagagtgtgcagttgcaagatttaatagagtgaaaacagggctcccatacaaggagagaggacccaaacagggttgcccacacctggctcgaatgcctggggtttatagcctgatcattgtccctccctctgtgctctcaggcaatatatgatttgactatttctttacctcctgcttttagcccaatttgtattttagtgagccctctttactacctgattggccgggtgtgagctgagttacaagccctgtgtttaaaggtaggtgcggtcaccttccccagctaggcttaagaattcttagtcggcctaagaaatccatctagttctgtctctcacttcctttgattttgaagtaaacaatctcttaactttgggatagcctgagacaccacctctgacttctaaatgactcaatatcccgaaaacccgtggtaatctcagtccgtctcagctggttccaattaacctctttccaagctatctgtgtgggcctgctttagccttttaaaaggaaccagacgtttttagtcacaatggatgcatatgatagcatggtttacctcagatatgctgtgggttagcttctataggctttcttatatttaatgctttcccctgacttcacatttaatgcttttccaaaaatttcccaacatcactaaggcttcagcagccctttaggaccagtatttctgggaaaacactcaaaatacatctgaatctgtgtcgtatatcatcacctagagcatgccaccatctagtttcagcaaaatcctagtgattccaccagacaagaaagattgcctcactgggagacagttgctgattcctgttgcccttcactggtctactttgataattggcatatgcctttcctgcggcattttatcacataaagctttgctgtttttatctgtgttcatgtctttctctctagatgtatcattaaaggcaaaaacaatattcatttagtgttcttcttacctgtccttctctccccaatactggaatcctaacaccatgcattgcacttttttggtgttcagggttctaggaaagctggtaaatggatgaatcataaatgtaatttggggcaattttttcacaaaatgtgtcacctatctttgtcttttctctgcccactcatactggctttctgtggcttctccccatctgtctagcatttctctctacctctgaagaatatcagtctggtgcagccctagcaccttctttggactcattgttaaagatgttgaggaaggctagctccaaggtttaccgtttgcatttagagaactgtcttaccatgcctggtttcttcagccctgataagactatgccatcttcaccctcccttcccctgacccttccttagccacctcatccaacctatggcaactcaacaagaaaagcttacaaagtcttccttggcaaaagagctggttgacttgagccaaaggaagctaggtgcagtgtccgattcactcccccaaatcccccttgaaactggagaattgaaaacaatctggtttctctctgggttctttcattataccatgttttcttgcatatagacagaataatgtggttgttacaattatttataaatgtagtgtatgccaggaactgatcactgtgtgtaacggatacaccattatttttcaaggaaaaaaaatattttgggctttgatgattactagacagatgtccttggtgataataatcacagtaagtcccaactctacccagtacttcacaattctctcagtgctttcctacttgttgtctcctgtaatgacgtatcatatcctgaatggcgggagggcaaggatcattagtctcattttacacatgctcattctgggactgggagagagatttcctgatttgcctaaactgccacagtttgtcaatgatggtggagggatgggggcaacactgaacctccagcttcctaagactttcccactttctcaagcttttgtcgaatgtgtcattagtggcattcactttggtcaactttggttccttgggtattgctggctccccatttttttggatttaaactcttcaaattaaataaatcagatttacatgttaaaaagaaaagtcttctctaaaagactccttcatttttgtaaatctttgtaataatttcaacagaccttaccttagaatttcaggcaataggtacatatcgtacacctctgttagttcttccagagactggcgcaggggttggagatgggagggaatagatgggggaaggaatgtggagcagggggcctggactccagtccaagctctgctgaaggagggccttttccaaagtggatcctcctgaaggcagaggctcttctagaacacataaatgtgcagcattggctagtaggagtcctgctggaacgaggctgaggcacatacaggatagtttataggagagtcaagtcgcatgcattaaaattaaacaagcacttgggctttgttggaataaagatatgctagaaatgtcaccaaggatatataccaaatgccaaatgtagtcatatacaatgaaggagagcaatggtaggagaggtgtcggcaggctggagagaacaacaagtgctgtgggctaggaactgtgatttggaagtgtgcaacccaaactaaaaggagagaaaatggttacagccactggcagcatcccagagtcttacctactgcctccggtcctttgcaagtaggtagggtataaatataatgttatctgcccagcacaaaggagaggggagaaaagaaagcaagaggcagtcaaagggacagagcctagttctgagtcctgttttaccactcaatccctggatgaccttgagcaagttgcttctattctggacttcattggtaacagctaactcacagagtcaatatgaggattaaataagactattggctaaaaggtgcttagaatagtgcctagcacagagtaagcacttaataagtgttagctattattgtgataatacatgcatagaagtatatgcatgcatgtacatttaccagtatgtacacatttgcacacacaaaatgcccattgtgatctgcaagtagcactaggatccaaaaattaaaagttattatgttccacaggccaccttgaaaagttaggggaaaaaaaaaacttgaccttcatgtgttgttgctgtttttaagtggctcagcactttgaaataacatttggaggaaagcattgcaatggaagcagcgctgtgtgggattgatcctggagacctgggctcaggcgctggagcacaatgtccaggaagccaaggcctgtttggattccttacgccatgacatggaggcaaagctcctcttggctgccaacccaagagcccacagtcctgtgagcttcacccttcctagggctgtttgtggtctgggccctcgaggttgtgggagaccagtttgattgctaagggaaaatcccagaatggctcttcttgtccttaccgaatcactacccttcaccttcctgtgtcctgccccagcctggagggcctacctaggcctgctattacttccaacccagaagtgtagcgaattggggccatgaccacaaggtttacacttggttacttggtggaatatgaactcttgggcaagttacctaatattgccaagccacatctgtaaagtggatatgagaatagaatctacttcatgggtctgattgtgaggtttagatataataaggtgaagtttggcactcaataaaaggtagctgtgctcattcttaccagcagcaacgagggcagtattgatgctgcaggcagagagaaagggggaggctgctgcctaaagcacccttgccactcacatgtaattaggtgaccatacaatttattatccaaaaggagacacttaagattggagggggtgcaattaataatggtgccaggacaacaggcataaattgggacagtcttaggcagacttgcccatgattccttacccactgcccacccatcatctgactacacctctttcttcaaagcatagatctcagtgggatatttttcttcttcctgatcgctttgttttttgaagggtatgatcgctttgtttttgaaggatatgattctgccattaacattagctatcacttactgaggagcaaacatgtgtttgcctttgtgttaggtgttttatggaaatgagctctaaaatccttgcagcaaccttgggaggcaggtgctacttccattacccggttatagaatgtgaggcttagggaggttaagtcacttgcccagccaaggttacaggtctattaaatggtatatttggtatttaccacttgccattttaacagcattttattggcctttgcggatcagaatgtttagcggtgaccccagaatgacttgtgcaggacccccactcccacctctcccctgctacactcatggggtaggtgtcagggtgtatatcttcctgtcatacatccaccaattccccaattctcaggtcatagcagtgggctgaataaccattggctgccctcagatttccgcagaaatggaagcttcttaaatataggctgttaaacctggtttgagtttctttgtaaaaggaatcttgtatagtttccataagacctaaagattgtacagctaagcctgctgaagaatttgtccttattttttccatttcagatattcccaaggttaggtagagggggtggtgttgaagagcaggctctctagagccaatgctgtttattaataagctgtacagacacgcttcttccaggaatgtgcacttttgattctgctgtggtgataaagatactctgccttgcccattaagcatttgttggtggaaaacattacctttaaataaatgtctggttctatgtgagcaaagctagggctcccataaaattgggcaatgatactctgaattcagctgaactgtttgggcaactttgtcacttctggggccatcattttcaggatagttcccacagtgtgagaaaatgactgcttcctatagtactgtcaagagtgtgaaaagagagctctttagcaaacacattatttatccatccttaaaaagcttgtcacctccagggtgcttgttcagaagtaatctcattacttaaatcatatcctagcatgtggaaaagctccctgagttccccgcctgccccacctgctgatttctcaggaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgtaagcataacaaactgaaaatgtaatctgctttcaaatattctgttgagtaaagattccttttaattactttaactgggtttttgtagagacaagggaccgttctctgtttcccatgtcataaatgactttaatgagaaatggtgaacacatcaattagggcaagcccacctgcactggggctaccctcccttcaactccccataccctgttgggtagaaaccatgtgggaatttactgatcagctgttccagagacccttagaacaaatagcgtttgcccccaattactgaataatgcctacataatttggaaagagggagatttcctactttgggtaagaacattgcctccctcaccatcagggcctttgaacacactgttctctctccctggaataagtcactccttggccatttcttctcctggcaaacactcactcacccttaagactcagcttaagggagcccatgaccctgtttgaggttctggagggttttctgttacatcctcccataggaccccacagctcccttcgatccatctcatctcatttttcctgttagccaactaacaggaaatttcagccacaaatgagcacatattaagtaatcactgtgcatttgaggaatgccaacaccttgaaaggaaaccgcaagttgtaaacagagtttatacctgaggagacttactgatcattcaaaacattcaatatattcaagtatatattgaattgttagcatcagagacacaaacagatattgcatccataaaaacataaacagatagtggacattaatattttagtttttgaaataaaaatgtgaatggacgacccgaaaggacaaacagatgacaaactggattgagagagtcaatcaaggaattatcccagaatgtagcacaaagagaaaagagatgaaaaatatgagaaaccaggcaagaaatatgaaggatggatccatgagactgaatgtttgtctaattggtattctaagaagcaaaaatggcaaaaatggaggggggtggggccacagtcaaatattaaggaagaactgaagactgcttgaagtctcagaagtaaaaagtcacatacagatatctcactggggccaatccttcaatcaatcactgaagatagacttaatttgggaagcagtcaaaggtcatttgcaaccaagtgtggtagaaaagatggataatcaaacctagttcttgtcgactatgagacgtaagttaaattagatgaaaaattttaaaattatttgcaaggctgataatagacttctgaagatgcctggcctctgctatcagcacccacaggcagtttagctagttgagtttgctctgtttttctcaaaacctcctttactttcctcgtatcactgaatgggaggtaatgaacaaattagaaactggggtcgactaagagagcactgcctctcctgtattgtccctcatcaactgcctttctacttatatttccacaatagatattattgcttcctaacacaaatctagcctcttcatttttgttatcccccaactgctttatgcactcctacctccagcattgcaaatacctctcctctacttgccatcaaaatctcaaccacatttcaaggcccagaacaagtcccatcattcacgtgaagcctcctttcgtctgtatgctaatatctctttgtacttgtcaacagtaccaagcttcttagttttctctcccaatagtagactgcaggcttccctagagctgagagtgtgccaaacatttgcttaatgataattaggaacttctccaggtacatgttacaatgaaaatatcccaggagggagaacaagttgaaggattagcccctggatatgaattattttgatgaggtaatatcctctgactgggcagaggatagtaggtggatagaaaatgtggggaaatgacacataaaaggaagtgtgggtgggaaggggcactggaggcaaatgttgagaatcccaacaagtgtgttcagtgacctcgtggctctcacatgatcccctaatatagctgtgacaagagggatgtattgggagctacacgactaccccactccccaacctgctccatgttctcaagacagatatagtaaccttttcaaaggcatatagctctttagggacccctgagggcacaactccagtccaaactgttccttccagctaccccagggactgtccattattatttctgctcttgctggagactgaatcataataagtttattgaggttttgctatatgctagacacctgataaggccctaacaggctttatctcgtttcttcctcctagtaaccacatcaagaaataccactatttcccccatttttttctaatgaggaaactaaggtagagatctagcagtggacatagtgatagagggtccccctggacacaggaatgtgaatggtgtggggaggaatgcagaagcagctttgagtttccccagccaattagtttctcattctctctacctgcaatgcccttcctcagcttggtatcttgcagagtaatgcttttctttcaagacctactcataaagccataggtgaccttcctagggtagtcactttctcctctcttttcatagctgtttatgcctctgaacacttgtgcaatctgtcttccccagattaactccgtaagagcaacaacctcatttccccatattcctacagcctagagcctaaaacagtggctagtggctaggatattgtagatttactcagtgttggaggtgaagacagtggcctccacaggcgcacactccgtgtgccctccatgcactggaaccctccttggcagaaacctggagattccatgagccttgatgccctcttcagggccacagtgtgagtctgtcagtctgagggcccacagatgggatatcagggtaccaattttgcccctcactttccccttaaacgtttctcactgattctgtggaccgaaaaatgtaacaccccattatcaactgtaatttggggtctagttaaaatgaaaaatcttcaagagaaattgtattctcttataacctggaaacaactttctatcagtcagtgaaggtggttttaatcaggaaagagcctctgggacattggacacctgaggcagaaggttgagaaaggaactgggcccaggagttgttcatttgaggtctttggattgggctttagggggtctgggatcccagaattgtactgaaactttgcatgttgattcccgagtgtgtttctccagagcaagattccaccacgttcactggatccttagaatgggtctgggactctaaaagaaatgagaagagctagagaagttggccaaagtgggccacatgcaccccagcctccctgacgtctcagtgtatctctgcatacctgggcctacaggcaccactggctggcctaagacaacgtggaagaaaagaaccaaggaaggcggcagggcaaaggcacagggaagggctggggaggggcagctaagacaaagggtaagaatgctgggcagcagacacagagatacagagataagaggggccctgtggctcaaccccctcattttatagataaggaaatggacgtccagagaggctaggtggccccagcactctggggtcagctaggagcttccttgccagagtgtccctgctctaggacatctctatggcctcacagtctgttcattaaacaacagataagctctcaaggaaaggccagcagtgctgctgctatctgactgtttgggtggtagctatgggccactgagttgctgggacttggcatttggaatcactgctaagatgtgcagaaggcaaacatccctctgaggatatgtgaatgtatcattctttgatgaccccaggcctaaaaggcttaagaggctaaccattggttcacttcacttcacaaacatttactgagcacttactgggtgtgaagcacttgtggtagcccccgggagctagatagaaaagcgaggtgtgagtccttgctctggaggaacttatgttgtggaaatattgacagacattccctgtttctgccgttacaagaacttatcatatccaggtagatgcgcagaaggaagcaaggccacttgggaccgcagtgtgacaaatcttggatgccaagactcaggcatggctctggatctcaccacagaaagaggttcagggggcctctctggctggcggcacctgggctgccctaaggattgtgtatccacttggggaccttccgtctttgctaccagaggcaaggaatcccacaactccatgtgccacagagaccttaaagccggaggaacgacaaacaccaccactggcacttggctccggaggcttccctttcgccctcacctcagtgtcccgaggcagtttcagtgctccccctcagcccgggcgtggcaggcctgggaagtgaacaggtctctgagactcgtactcagctcatctggccccaaagcctgttcttgtgatgtggtctctgggtcttgtactcagctcatctgaccctaaagcctgctcctgtgctgttgtcacttctgccttttccttcctcaggttaaaagcccagttttggctggaaaattccactaccttatctactctggggccaggtaacctgttaggtcttacaaaattgaattgaaaagtgaagtcatgggaaacctcttagaaaaaatgactgctgttcctggaacaatccccaactggccctttctgcctcctccataaggcgaggtcagactcctcgtgagaaaaactatggtttgggtgtcaggcaaccccaatgcaataggatctgggggatcaaccccaattcaataggctccccaaatagtgcccccactttgtctcatggcctgaaatgccttagataatcaagaagtcttttaaaacagtcatttctcactgtgtttcagaaaaacttctctgggagactctatcagatgcagcccactgggaagacaatagattaggtatctgaggaaccagaagcaccatcagacaggcaaataggctagctgagataagggcactcttggactactattgcttttgactgccaatgttcccaagtcccaggcttgctggtagtcagccaataagtcattgtgaagaaaggagtgattctacaaacccacatggagcacctcctggggaggtgttgtgctagaagtcacggaacctcagaggtgagtgagaaagccacggtcctgcctgatggatgcccaagagccttgggtcttcacacacatgtgaaatgtgggttttagcagcaggtacctttcatacaccatcaatagtcttccctatgtgggtaaaaccctaggggctgaggtctcccattggtgccttcagggctttttgctcattccacacaaatggtcagtcagagaccacagcagggatgggaactatagggtggacaaggcatttgccctgaaggtagtccacaccatgtgtatctagctgcatttttcctattggttcctattgtcttgctcctgctccagcagaagaatgtcccagggaatcactggaagcttgctaggaagaataactggaacctcaagtgtcatgaccccagtgccaggggatggaaatcatattacagaatgtgcacttgggtgaaccttccctgcttttaagtaactattgacaagtgaccttccctggatctcatgtaagtggttcatttttaaaggaagagaactgtattattagaagatcacagcatttctttccagtcctgatactctgtgtctccttgatgtagaagttcatgggcagctctacatgtcttcctagagaactgtgattctcataagatgtcctagctagcagcaccttcagtttgcttgtcttactgcctcccgcgtctagaaagaaaactgaatgtctgaatgtagtaccctgctcagacaagcttcctaataaatgtttatttaatgaaaccctccaaggctctgatttatatagtgccttggcagtcaaaagcagtagtagtccaagacccatgtcggagagaaaaagaggaggagtatttataccaggtaagagatggctcaggcaaggagaagaagaagcaggcttgtcttgggaaaccagtggggcagaactggatgagcagggaaacatggaggaggaagaactcagcaggtaagatgttgtggtaaagcaggagtcagactttgagtggagagaaccaagaaataaggctgggtcaagatgaatttggggtcggacatggtggctcacacctgtaatcccagctctttgggaggccatggcaggtgaatcacctgaggtcaggagttcgagaccagcttggccaacatgatgataactctgtctctactaaaaatacaaaaattggacgggcatggtagtgggtgcctgtaatcccagctactcgggaggccgaggcaggagaatcgtttgaacctgggaggcggaggttgcagtgagtcaagatcgcatcactgcactccagcactccagcctgggtgacagagcaagactctgtctaaaaaaaaaaaaaaaaagatgaatttgaaagtcttgtagacaactggaagcaaagaaaggtttttagcagaggattgacgtgatgtaagctgagtcaaaaagcaaatctggcagcaatgtgcagaacagagtgaaagagaaggtctgagaaggagggtcttggagagtttacaatggggaataaaagccggacaaagctggagacagtgcaaactcaggcaacaggtttgtaacaagcacgtatgaaggcctggacactgttctagaagcggaatacagttctgaaagagagagacacagatccctgtcctttgggaattcaccttctagaaggagaggaaacagagggaagaatttgacttttcatgaattaatgcctcattttactctgtaagaggtgtgaggaaatttacaaacatacatccactcagaataataaaaataagtgattttacctattgtctttgacaacatcctttcattagataaaatggtgagttccctatggctgacattacaaagtcactcagaggtagcttatggcctggcaccaaagcatggctagacaaaggtagttgcaaaaagaacacaagtgactagctcccagtgtgtagctccgtgaaggttgtgacagttggttcagatactaagtaatggcggcaaatgggctggagtctccactgggctcatggagagatggtttgtttggcatcatgcctggtcctttgagaggagggctgtgctgcagtccattccccaccctccacattcatgtcacctgtgttgcccttgaagacactagagcttgggactgccaagagaggattgagggtccaccaggaattctcagtagatttttcacaacagaggcttttgagagcaattaatcttagagagtttgaggtagggtaatttttggcaaagaaggaagccaggaatttgccttcaactgaccactgagatatgctttgatcttgaatagagcagagggtagggttaaggcccattataaaaattaacatataagccagaagattaaaaaaatacagggacgtatcttgagatacagggacacgacattattagggactatgcctagaactttgtgactggatatggttaggctgggatgggaagggatatggtaggaaagtaaagggaaaagggaagtacaaaacaccaatattttgaagctggatgatggggtaatgatgtataagaaggttaggactcggatcacttgaggtcaggagttccagactagcctgaccaacatggtgaaaccctatcctccctactaaaaatacaaaaattaactgggcatggtggtgcatacctataatcctagctacttgggaactgaggcaagagaatcgctggaacctgggaggaagacgttgcagtgagctgaaattgtgtcaccactgcatgccagcctgggcaacagagcaagactctgtctcaataaataaataaataaataaaaataaaaataaaaaagtaaggacagggggagaaggtcaggaggaggttgacagattgggttttagacgtaactatggagtaatggtgaaatatctgcatagtggagttcactaggcagtcagtgcttcagacatggagaagacagaggcaagaagggaatagggggaggtgccttcacagaagtaagagcttaagagaggaaaataatgagttctcaaaaggagaataaagcagagagggcaaacgctttaggctggagagatgctcatgatctctcatgggcatgggggctgatggaggaataagaacagctgtagaggaatagaaacaatgagagaagcctgccacaaccatcactggagaacagatacaagaaggaggaatggccaaatgggtccaacgccacagaatgagatcaagaacaaacatagacagggaagaggtacagatcaggcagtagtaaggtcacgtgtcagctctcagagacaggttttggtgcgatcaggcagaagtcaggagatgaggaaatggatagagaaaaaaatgcatttctccaggagctggggtgtgaaagagggatgggccaggtttgctggagagaataagagggagtgcaagcttggcacccagccctcacatccagggtggctgggtctgtttccctgctgggccagtagcccccacgctaaaaggatttagcagggtctggtcatgctaggcagaagttccacaaggccagggcctgcctcccctccctgtggcaggctagggttagggctatagctgtactaggggatctgggagtccttcgtggcactgtgggaccctgaatgtgttcagacccccaggtcatcaggacacctgggctctgctgtgtccccagaggtttttgccctgactcaggctgaggactttgggtgtaggactcgcgttttcttacgcagaggttggtggggcgttgaatgaagttgttagtaggctccacgtagcacaggcacacaggcctagtgcatcaagtggccagagtccctgcttggtgccaggccaacgtgggatgctgagcaggcagagaccactctgcaaataacaatggtgcgacccaagaaaatgaccctgagagggcagtggagacccaggcatttgagacggcctggcaaatgcatagcacctgagggccatgtgcatgtacatgtgtgtttgggggtgaggggagggtattactggccgaggggacatgtaaacaacctctgtgcaagttctaggaccttcctatattcctgtaccactatttgaaggcttctgtttaacctacccacgtggcccattagaatgttccactgaacaggaaaaccaatgtgcattcaggagagaatctcaaaggacctttccagctgtggcattcagaggtccataaagcttaatcctttaaaaggaatcattctaaatagcccaggagtgaacataaatgaatgaaaagtccatgaatgtggggactaaatcccataatagggagcaaaatggcatgataaagagcatgggctctggagacagaccacctaggccccaattccagctctgtcacatatgagctgggtgccctagggcaagctgcttaactgccccaggcctcagtttctccatctgtaaaatggggataattagacttagctctcaggcttgtcgtgaagatgaatggcttaatatttctaaagtgcttagaccaatatctgacacatagcacatgttttctaggtgttaaaaaatattctttttgatggggttgtttgtttttttcttgtaaatttgagttcattgtagattctggatattagccctttgtcagatgagtaggttgcgaaaattttctcccattttgtaggttgcctgttcactctgatggtagtttattttgctgtgcagaagctctttagtttaattagatcccatttgtcaattttgtcttttgttgccattgcttttggtgttttagacatgaagtccttgcccatgcagatgacgagttagtgggtgcagcacaccagcatggcacatgtatacgtatgtaactaacctgcacaatgtgcacatgtaccctaaaacttaaagtataataataaaaataaaataaactaaaataaaatatattcttaccctgctggatttttaagtgatgctcttgtcggggatctttatgacatacttttgaggaagatgagaaacgaggcttcttaactctgttaaacattttagacacacaaacagtcctcacttttcatggcagtatggggctgtaaaaatgaccatgcaagctaaaaccgtgcaaagcaatcctaaaaatcaagagaaaaattaaaactgttctgtgacctttaaaatttgttgtcaaagcattagaaactcttaccataggttataagtgtgtaggggaacaaacaaacaaaaatagtaaaatattttaggacacagtaatttgaaacattagaaacaatgcaacattttaagtgttttctttctttgtgaaaataaacttactaagaggttttttaaaagtgcttgccttcttctctttgcataacttacgatactgagggaacatcttttctatgccagtgaattgccatagtcctttataaatttgcatcagcttgcaacatcttatctctttgctttcagtgttgtgaaatacctctggaagttcctataatgtgaagttttttgctgggatcacttcctgtgggacatcttcatcctttttgttgcaaccactttcctcatttatgctttgaacaatggtttcaggtttcatcaatataaatcgaaacttcaagggtcccaactgtcagaaagtcacatagaacttactcagaatgatgtcaaattccactctagaaatttaaaacctcaccctgttaaaaatagcttgtcatcaacaaaggaaccagatgataacagacacaaggctgactttttagtttcgacttatatatattaaaaaaaaaacaaccacaaaactgctcaacataagcacaatgtgctttcaggagagaatctcaaaggacctttccagtgcattttcagtgccctgcacccaagcattaatgattatttaaatggtagaataacataaaatgatgaaacaactggataaattcaactatgttgtaaaaattttgtagttgacagaaatcagtctttggactttaagatctcatatagatcagaggagaaatataatgacatactccttaagaatctgatgaaagttatggcctttctccactagaatgtgccgattacaatattttatgcagtgtttcaaggaatacacagagcccccaatatccagttagaagccctggctgtgaatctagaattttattacaggtgaaacccagcacaagtctgattgagagccattgcaagtcacagaaactctaggccctgtctaagtaaaggcaaaccttggagtatgtcatctgccactgaaaatgcatttaatgatgactcactctttcctcactatacaagtttgttcaacctacacctcttcagctacagactacctaccatccctgaaactctgttctgaggagtaaagggattacaaaacctggctgaaaagacagattcaatggcatgttgaaaaacacagcagaaccagcacatcagactgtaaattgattgtcttgcacaggatgttagctgctcttcgaatgaggttcctgagtggcacctgagcctattgctggtggcatcctattctgcctgttctctctttcttcctccttccccattcctttcattctcttctcccttattcttcctctgcaattctttttttccacactaccgttggccggtccctagggatactgtttaatctggcccatggtacaagagattttagatcttcattgaagtcactagagatggcctgagtgagtcactttgaattcaatagacaaactgatggaaggctctgagaagacctcaacgatgcccaagaaatgtgttcttactgtagaaacttactattttgatcaaaaaagtcattttggtcaaaaaggggagttgggagattgcctttttgttttgaaattgatttggcttcaagggaagaagattgcctaaacaaaacctgctgatgaagtcacaaaatgactccacctctggaatgagctttattttcttataatttggcaagaaatttggctttcaattgggaatgcacgtcactctacccactcaagggcaagatgataaggttctatcagaccaagcgtctaaaggaacctgagactctaccaaggtcagaaatgctgcaattcaagccaaaagatctttcttgggcttccttgttttgacttgtaaccataaattagtcttgcctaaatgtctgatcacattataaaacagtaagtgaatctgtactgtacagcaccctctgaagcaacaggagctatagatgaaccttttaggggattctgtaatttttctgtccctttgatttccacaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtaagtcagtcatttatttctgtatctaaggagattatttacttgggattttggtccatgatggtaaagaaaattttgcaaaaggacaaaaagcaaacctggaaagatctctgaagactatgtctgtgttagcaaatgaggacttgggagaaaattttcagaccaattatctgcacattttaaatgaaagcacttaaaaaatatcttagataaacccttccactctgtgctgtgctttcgtaaagtagacttggcacaagtaccctttaaaacaagctcaagatggggtggagtaaagtaaaattccagggttttctggttaacttttaaaaaatagattgcaattttgctctgaaggtgaaaatgtctctggaacatcttcttcactgcttttcttctccctttcactttgtttccgccatgccccctctttgtcttgtatttatcccttctctttattccactcatcattttctcttattcttgggaatgtgggaataagtgggttgcacttaactatttctctacagactcacccagtaagtcaatactttcattaatgttactgatttagatactaaaacttgtgccaaactttccactatatcaggaaaaccaacagggagtctaactccaaaaggagattcactgaaaaatgcttaggaccctcattgattatagaaatgtcagacaccacagtgaactttccaataagnnnnnnnnnnnnnnnnnnnnctgactcgaagtcacgctcggtaccccctggaaagactctgaagactatgtctgtgttagcaaatgaggactctggagaaaattttcagaccaattatctgcacattttaaatgaaagcacttaaaaaatatcttagataaacccttccactctgtgctgtgctttcgtaaagtagacttggcacaagtaccctttaaaacaagctcaagatggggtggagtaaagtaaaatttcagggttttctggttaacttttaaaaaatagattgcaattttgctctgaaggtgaaaatgtctctggaacatcttcttcactgcttttcttctccctttcactttgtttccgccatgccccctctttgtcttgtatttatcccttctctttattccactcatcattttctcttattcttgggaatgtggtgatagtggtccccatttttctcccactgtctggatcccattcgacccttatgggagcctggtagtgggagaaaaatggggaccactccagtgctcttggaacatcataccccgggagaatcttcaacaagatctgtggttcaatcaaaagcagagaataatataattattcagataatcccaatagaaaaccccacccttccacccttaaagccgcaatgatcagatatcagattaattcagaatgacttgaaatttcagactgcttctttaggtttcagtgaaaatgcttcattgcagacacatctgttcccaattccataagatatccaatgagactttaagagcatagttacacactggtaagtgtggtgggcctagtctcagtgggatcagaagtgggagcatggggctagcacaaaatgctctgtgtctggattctttttaacattccagataattgcctgtctctctgcctgattcagcctgatattttagattactttaatgcccagtttaaaggaacatttagttaattttgttctctgctccctgacagggtcaactctagagaagggaggctcagagctaagggacaactgtttcatggtctttaacttgaactctgttccccagtgtggcccttcctcactggatttctcctctcccaagggggcttctaggtcagggtcagtgaatggtcggggtggggtgagtaagtggtgggggtggagagcctttttttcctcttcttcccttcataggctcaggtgctaaattccaatttgtctgtgttagcagacaatcaggccaggagagtccagcattgcccacgcagcattgcccatccagtgagccacaggttctcaagcttttaagtctatgtaagaacacccagcaggtaggagcttgttaacatttctgttcctggaccctgctcctgactttttgactcagactcttcaggcctagaaacatgcatttttaaaaagtccccccagatgcttatgttaatcagcactggtggaatttccttggacccttgaccaaggaggtcagcctgttaggacaagcctgagaaccagcagccctgaagctctggatcagtgggagagtaggcagcacctcactctgtccaccatttctgggccagggccatcatgctgatccactgacagtcagatcaagtagcacagtgattctcagcactgtctgaggtaggagctcagctagtttggggttgctatttttaaaaaaatctcccttcctgattttttatgagcagccaaggttgagagccacaaatatgagcctaactccttcatttgacagaaggggaaactgagacccagggagttgatctgccttgcccagacaaaacactatgacaagcatgagaagccatggagttcaaacttgtcgttttacaagtgaatggttaaagcccagtgaagggaaatggcttgtcatctccccagctggacagaaagtgggaatgtagggggaccaccaggaagtcctaaagcccaggttgatgatcattttgctagacaggtagtttctagtttcacactttccttttgaaaacagaaggtctagttagaatccactagtagcacagactgtgagatcctatggtttctggttgggggagggaagataagaaaattggccttgtttggggtggcttttgctgatcaatactcctgagctcctgccagctccctttaatcagtggctctctaggttcttggttttagaggtttaggggaagcacagagtcaggaaagctcaggaacagtgaaagctggagggacttataatgatttaaagcccttaagtgagttataatttacaaagcagtttcgtgcccattttctctggtgaggttggtgtgtttgtgtctgttttgtagttggcaaaactgagactcaaagagtcacacaactagtaatgatgaaactggggctcatatctaagcttcttctagccgtatttactgctaagtaaacaggctgccctgttttcctgcttaggggcaggaggatgtgtgaaaagattaaagagatgtggtttctgccccgaggggattatataaaagtagtaaagacagtcaaggaaacacacataggtggttgacttagtgccaggtaggggctatgaaagtcctgaggaaagggtcattcctgcggagaagggggagtggccgggggaggggggcggggttggaagcttcagttctgaaaaattgctcccagaccactgatctgggtcaggactcacagtcacctggcactggctgctctcccttcccccaggacgtatagccatccccagctctaaacaagggtcctctccctccagatgccatgctctgcccggggtaccacatcccagagcagggaactaggggggagaaaagcatggcaactgacattcctctttttcttaagataatatttcacagaaaactggacagtgcggtgacaaatttgccatcacaatgcagcctgacaaagcggatgttacccttgttccagaagctcctcgtgtgcctttgtaatcactctctctctctcactccagagcaaaacactgtctttgattttgtgacagtcactcccttgctttttttttttatcattttaccacataatttcacatcccagagaatacaggttaattttgccttgttttaaaggttttagcagtcaattcatacattatgtattcttctatcttgcttcttttgctcaatagtatgtttctaagatccatccacatcgtggcatgcaggtgtagttcattttcattgccatagggtattgagttatataaatatctcatggtttaattgccagttccactgttgagggacacttgaggtgtctttagtttggggctattgtgaacagggctgttctgaatgtatatgtgcacacaggtttctctatggtgtacatctgtaaggcgtggaaagcaacagcttgttgattaggacagctggggagaggtcccagctgttggctccaaggaggctgtctctgtacaaaaatgcagcaaagtattcactgcttcttttagggtgtgaaagaggctcccaccatcattgcatgcctagataagcattcccaaatctgagaagcaacgatcagcttaatgtggctacaaccagaatatttccctaatattttgccaaagtttctaccttcctccagcattcttctctccagctggagggtgggtagaaggcctaagatatacacgtaaatgaaaaggtcacactgtgttaacattcttttatttagtaattatttttcacatactctcctctcttgcccctagactctgatggggaccattatacttataacatctccagtccctaattttagtgtctataccagtagtatctataccagtaattgtttgttggatgaattaagctgatatacaattgatcgctagggactcaaaactctggttctcttctggttagaacactcaggttcttaatctaagcacaaggttcaatctccctttttcagtagatatatctctcctgcgtcacagcttacatttgaatggcaggtcccaaatattaagatttttacatggcgggctgggtgtggtggcacaagcctgtaatcccagctactcgggaggctgaggcaaaagaatcgcttgaacccgggaggtggaggctgcagtgagccgagatcatgtccctgcactacagcctgggcaacagagcgagactctgtctcaaaaaaaaggatggcatttaaaacttcatcctttatattagatacacatgcctaattaatttttaaaatttattcaggaaacattcgttgagcatctacaatgtgccaagctataaatatccagtgagatattatattatgcatatattaattgattaaaagttaatatatctaatgacagtttaaggaaatacatattcaatcaaatctgctgtggaaatcttttaaagagcttaatgaaattattttaatacaaagtcagtcatctactgtataatgtagtgttactaaaataatcacaagattaataaccttagaccatattttggttctgtaggtattagcaaagatcttttatttaaagggaaaaaagagctgacagtcttgctcatattaactcagctattacaaagtaaaagactaaacactgtttgctgtgtttgggattaaacatccaattcagatgattcaagcaaaagcttacactatgtatattattacacaacttttgcccgtaaggtgagaatgctgtttcacgtagttaggcatgttttggcttcagaatgatttcactgacagaatggaattaaaggagaaagatttagaaaaactgctacttgtcaactcctgaaaacattctaaaactttttaatctaacgttttaccaacaccagtaaaatcaagctaccaaggttgttctctgatataagcagcaccaaattccccagttgttccctggacgcatgttctttacaattctgccatcctctgcataagcaagattgtaagcagccactactctcggctaaaaccagatcatgggactcaaactccaatctagaggttcaaagacccattgcctgactccccatctcttagctttattttgcctaatgagatttagcttaagagccttttcttaaacggagtcttttttgagggtaacaaaagaaatagatgttcttggattggacattctccttgtagatcttgtttctttcagttgaaagatttcctacaaaactacagaccagttttaacccacccattgtgtcaaccggggcactcaaaccaaaagtttccagaaaaaactaggcgccaaacagatctgccagattgtcactcatcagtgtttccatgtttgctaccaaatgcaccaattgacttgtattagaaactcactgataccagttaacctgggaagaaattagcacacacaccccagttcattcagactgaaatgattgagaccaaataaaactagtgtggtatggatactgaactcctttttactcatggagaagtgaagagcctcatgttaagcgtgaggcttttgttttgttttgttttgtttcaaatcactttattcgtgattcacagatatacatcacatgtaaagaacacttagctataaaagaacaaaaacaggagtaacacaaaacagttgcaatttttggtgtaactaagatgttgcttatgctctgacacctgtcctaggtcctggctactgcatgggaattggacccctcatctcccacggcagattcctgtggatggggatcggcagtgcctgcaactactacaaccgggtgtatggagaattcatgcgagtctggatctctggagaggaaacactcattatcagcaagtgagtctgttcataatcgaagacatactttttaaatcgaggctggagttttttccacttaagacaactttattttgaatcttgatgtctttgtttctaacgctatatttttaccactgaaatgaagtgagcaatccccagaaatctaacattgcaaacagaataattgggttttgcttgaattgaagccagcagtacataaataactaactctggaaagttgggaaattatttacaatctctgtgagcagtgaatgtggaaacttagaagccagataatttgattttgacaaaacatactttagggagaggtgttatcttttctgctttcccaagttttttggtcttaaccacaaataaacattaaaaagaaccaagccaaacaaacaaagaaaaaacccacagaaaacaaaaataaaacccgagacatcactgcactatagtctgggtgacagagtaagaccctgtcttttaaaaaataaaacaaacctgaggcagaggtatctgattagcaatttgctaatttattctcctgccaagcaactgagcacctctaaaagagcagatggtaagccgaccttggctgaatccgattaaagtaaagaaaaaggaaaataaaagaacaagacagtagaaaaagaagtaattcacatgctgctttcccatttatgactttatgcgagtatcccggtggagtgatcttacataaatcaggaacaatattacccatttaaaaaaatagtgtcctccctctctgcattattatattttgtggataactagcagattgaattagctctatggttaactaaataggaattgactataaggaactagtttggtgaaatacttgttttcttgtttattgatcttagaaaatggagaatttcaaagatggcgtatttccctagactttcagccagctttagtagacttttagcaaagctatctgcaaacattgtctcattaacgcatgtttatattcgtaatccctgatagcgctttacccacaaactaaagctgaccagggtgttttaccaatttgttagaattattcattcagatacaaagactatagctcaaaagtaagtgaagcttttctaaactacataattttttcaggtcaagattacatacatcatctcataaaataccacggtatcctcaaagcccaaatatttgaagcagatattgaaagaagggagcaggggagaaattggtattattttaatacttctaaatatttcaaactatccaaaaagaatttttttgacctgggatttttgtttgtttgtttcattcagttttgtgttgtagcacttttaagagtagctgaggcagacctcacacaactaaacagaaatggcttcaggtggaaacatcatttcattgggttcattgtgaagtactctaatgcagtagttttcaaagtgtggtccttcaacaagcagcatcaacaagcctgggaacttgttagcaatgcacgttcttgggccccaccctgacctactaaatgagacagtctggggtaggacccgcgatccgtgttttaacaaagcctgcaggtgattctgctgcacacttgagtttgagaaccactgctctaagaactagatcataattacttttttattttaattctcctggtctattaggctctagtcagccaaatttaagtgactatgatacgttcttgatacgttctcattttaaaaatcagtacttgagtcacttttacaactggctatggtctcacaaatatcctggaagcactggtgtttgggtttgggggtagggacatttgccgctgctctttcatttccccgcacagccacctgcctttcagctctccccagcccagggtctgccttccccatcacctctttccctcagcagacaggtgaagtgacccccaggatatttatctagaaggatatctacctgctgcccaggatctagcacagtgccgtgcctctcaccctagctgtaccttagagtcacccagggagcttttcaaagccccactgcccaggccacacccccacttttagatcagaacctctgggggtaggactcaggcatcagtggtgtttaatactcccctgggagtttgagaacattccatctagagagagggtggaggaggaagctcatggggcaggagggcctctccccggggttacaggaagcagcgatgcaggactggttttgtcttatgctaaggtggtggaggtttaagactagaactggagtaaagaatgatagacttgagaaaggaccacagtaccaggacagaaatcattctgagatactagatatttcgatgctagattcttaaatctccagaaaaagtccgtgaatttccaaagacaattcctgaagtgcttgctcgttacagtgggggtggcatctgaccactccgctagtcttaattaggaaactgactccaacaaccccgaccgactcaggcgctggtgcacgctgagacgcagccacaacccacccacactaccatcagctctcccagttctttccttttcctgtcctctcaggcttttcacttgttggagtctttgtgttctctttaattgcctcagagcagttcaattttgttgttaaaggctgagctccccgcgggaataggacatgtttgtccccatctcctttccttgcctgctcttcaagtcccttccagcactccccgtacctcttgaaaagaccccattggacctcagaaagatttttatttttatttgaatagtttgccagattttttttttcttttgaaaagtttgaggtctgtagtcattacaactgtgtagaaattatggtccaacttttccaaccagcttcgtcccaaagtagtaggggctgcagaacttcaggggagaagtcaggcatgtgcgctgctgagatgccgcgtgtgccactgggggcgtggaggcacggtccatctggtgagctgtagatgatgtgtgcaccgttccccaggcagctacccaggcagctgtactctaaattaatgaaggtctgtaggtgctgcgtatgacactatatgtccattatatgtccctagattagtttttgtcatgaatacaaaaaaaatttatgtatcactcataaagggaaattagcaattagcatgctaatttgggttatatttgcatatctgttagcaattaacatactaattagggttatatttttacatctgtcttaataatgtgcaaatttacacatcatttacaggggcttccttcatttattctgtgaatatacatttactgagaatttattatatactaagcactgaatgattctaagttgtaatagtcattattggctcttcatccattaaatatttcttgaaaacttactatgtatagcagcaggtattgttctaaactctgggaatacagcagtggacaaaccagccaaaattcctttacctcatggagcaatatgtcgtcactaggtcaacaataaacaagtaaaatatatagtgtatcagtagagtgaccaattgtttcagtttgcctgggaccagggcctttcccaggatgtgggactttcagtgctgaaactggcatagtcccgggcaaaccaggatagttggtcacacttatcaggcagataggtgttacatagaaaaagaatagggaaggaggatgggggaggaccagttgtagagacgcaggtgtgattgtaaacaggtggttcaggcagccctcactgagaagacagcatttaaataaagacctaaaggaaatgagcaagtagcccatgcagagacctggcgggaaagcattctagacagaaggaacagcaagtgccaatattctaaggcaagaacctgagtggaagaatacaggagatgagagaagcaatagggtaccaaatcacgtcaggccttgcaggccattgtaacaattccggcttttaccccctgcaagaaaggaagccactgaagaatttgagagaggactgacacatatgactcatttatgtttcagcagaatcattctggctgctctgttgagaataggtgcaagaggacaagggatggggacagacagaccagttaggcaagaggtgatggtggctggtccaggtggtagcagtagagatgataagagatgagggaaaattctggacatattttgaaggcaaagccaacagacttgctgacagattggatgtagggtgtgagagaaaaaaaaagagtcaaagtgctgtccagttttgcattgaatggggacatcgtgtcctgagataggtggagcaagtttgggaaggggagagattagggttccattccagacatgttagatttgacatgcccagttgacatctgagtgggatgattgagtagagagaactgaaccttgagaccctctagtgtaaataggtcagaaactagcaacagagactgagaagagcagctagaccgagaagagaaaaccaggaaagtgtaatgtctgaaaaccaggtgaaaaatccatatcagggagtagaaaattgtgaaccatgtcaaataccactgatggggcaagggaatgcatggagatttcagtactgcatttagcaacagggaggtcacaggtgaccttgacaagagcagtttcaatggactagtgggggcaaaagtctgaccagagaagagaatcgggggagaagaatcagaggcagcaagtgtagacaagtcttccaaggagtttgccataaagaaggcaggaaatgggccagtagatgagtgagatgtgcgggcaaaggaattttgatttttaaaataggagaaattacagcatgtgagttgtagggggactggtcagttatggaggaaaatcaaatgattgttgatggaagagaaagagtgtgctaggtgagatgtgaagaggtccctggggacaagtggatgggttggccttgaatagggacatggaatttccatagtaataggagggaaggtggaatatatgggcacaggtccgggtcgttggggattgtggagattctcttgtagttgcttccactttcttgggaaaattggaaataaagtcttcagctggggctgagtagggagaatataatagtcatctagaagagtgagagagtgaatgggctggggacatgcagtagcattgccagcgacactaagggcccacttgaatttaaccgagacctgacagcaggcacgtgtgcgctaacgtacacacatgcgcacacatgtgtgcgcatgtgtggtttttctttttttcccagcccacttcaactgccaggtgcaagcacagaataagctaagagttggatttagctagagtgtggtcttatcagacaaccatgacaaagtaagaagagggtcaagggagttgaggattcagggaagggtattttaattttaatgattgacagtaattttttcccaactttctgttaagaaaattgtcaaatgagtaggaaaattgaaagagccgtccccctgccacacttttccccctgtgacattgacattttgaagagaccaggtcagctataacatatcccacattctgaatttctctcactgtttcatcagggtgtcatttactatattcatctattctctgtatttcttataaactgaaaattgggtctaaaggctcaattagattaaggttgcacatttttgcaataacacttcagtagtactaggaacttcatatcacatcacatcagaagatgagtaacaggttgtcccactagcactgatgttaaatttgatcactggttaggtggttacagtgagattcctctgttataaagattgtttatctcttgtagtcacctagaatttaagctgggtaagtgaggatattagagaagtgaaggacagtgaaaaggtgataggattgatggaacagatctacatgaggcaagtgtttttaaatgtttgttaccagccgggtgcagtggctcacacctgtaatgccagcactttgggaggtgaaagtgggtgtattacttgaagtcaagagtttgagaccagcctggccaacatggtgaaaccctgtctctactaaaaatgcacaaaaaattagccgggtgtggtggcgggtgcctgtaatcccagctactcagggggctgtggcacgagaattgcttgaacctgggaggtggagtttgcaattagctgagattgcgccactgcactccagcctgggcgatagagtgagactctgtctcaaaaaaaaaaaaaaaaaaaagaaggcaccaattagtccattaattgcctcctcatcactgttgaatctgcccacaagtgtgtgaattgtttaatcccagaactcaggtggctttcttctcatcacctaagagcttactccctgactacttttcattttgaacagacaataggtttgccatctttggagatgtcttttatcttcaatcatgcttaatgagggataataaccctagtgatcagacacccaacgctgtgcactgtccctgctgaggctggggactcagctggactctcctcagtgctaagaaatcctcactctcccaaataatcagtataacacttgcctctggcagtattgcaggctggcccacaagccagagccaggcctgtcttgactgccaggaggagctctgggctggggtccttagttcatcactgaccttctcttcacttttctgatttactctggttagataaatccagcctacttttagtaagtgaccttgttttaaattgctcatctgtggccagtcacacatcccttgctttatcacatcggcctgattagctttgtccctaacaagcctgagctttggattcaaaatagctgagaagttggtgccccctaaaggacacaagaattttaaaggttggctctttattactaataactagcaaatatttcgttgggtttgttttatgtttggagtttcttactctctttttaaaactgattagcaagttcttaaatgaaatggacaggccaatatgattaatgcagtatgcaaaagccccagggtcagagcagaaaaatagtgtttgtcctttaagtgcttaaaatttttaaatattagtttgtgaataaagaatatataaattacttaatttctgctttaattatagaatgatggaggggaaggtaagtaaagctagagttttcaaatattttaattagtaagaatttcattccttcctatagcataatttttctatatatgacaaaatttgaaacgtcagacaaattccccagaatacaaatggaagcatctggatttttatttatttatttatttatttttgctagggagaggcaaacatgtccaaaacttaggattatttgatgaatattatctggaatcagatcaagagaatatttaatagtgtttttatttgaaaataggtggtttttcctgaaataaatattaataagttatttatacaataactctgcttttttttttttttttgagataggatcttgctctgtcacctaggttggagtgcaatggcttgatcatggctcactgcagcctcaacctccagggctcgagctatcctactgcctcagcccaccaagtagttgggactacaggcacacactaccacaccttatatattatatattattatacaataataatcctgttctaatttcttgacactaccattatttcaggggcttacttttaaagcttaaataggactatggaacacatcgcagatgtgagagctggattaatacttagcccacaacctaatacattgaaccagagcagcgcttttttggtctagagtcctctgggaatgtatttcaacaggcattaactgaacaacctcattaaggcaaaagtatccttttaggagccaagtgtcaactaggagatggaggagcaagtctctccaacctgagaaccaattgcagatattatagtaaccacttgcaatctttgagggttatttgttctgaaaacctccatagtgggagaatttgcagctgtgaaacaaaatttcaggagaccagaggagagggaggaccaaagttgcaattaatacatgaaattttgtataaatattaagttcaccaagaaagtaacaacaacatctaaaatcaagataataccaatgacatctaatgcatcttgaatttgcataattgagcatcatgcaaattgccctgtctcatgactcatcacatcctgtgtcgtgggagaactctgtgaccctggagactttgatgagtcatgatggaaggcagagccccaaaatagcttcctttactaccacagtgaactttgcatgccagtccagccaggcgctggccaagctcagggctagaagaagtgcccaaggagatatttttcaagccctgactgatactccactggagggggcaggcctgattagagactggagttgggtggtactaggcaaaactgctggttccaaaataggaaaacaagactttagtaattccacaaacttctgattctgtggctcactcttgtagtgggtggcactttgtggagtgaggctggatgatacctgggaggctggaggttcttctggctctggtggtatggagggttcagcttcttagcagccttgcagctctgactccagtagtgggtagtattttggtgaggttagagaagaaagagaagtaaggaatggtatatgggtgtgtgtgtgtgttttctatctttggtgatgttgaaacagggagtcagtaggtagaaatgattcaactggagaaggatgtcctcatgctaacagaagtgcttattcaacccgaatactagaaatcatgcacattgcatttggagcaacatgcatttgctaagagagctacctcctagtcaaaatgtaccaccaggagttctcctgacccttaaaaattgacaccaaagtttcctgtcttttcaggtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaaggtaagcaggtacttagttagctacaatcttttttgtctatgaatgtgccttttttgaaatcatatttttaaaatattttatttatttatttatttatttatttattgagacaggctctgactctatcacccaggcaggagtgaccttggctcacgaccttggctcactgtaacctccgcctcccaggctcaggcgattctcccacctcagcctcgcgagtagctgggactacagatgtgcaccaccatgcctggctaatttttgtattttttgtagcgatggggtttcgccatatttgagaccaggctgggctcaaactcacggagtcaaacgattgacctgcctcggcctcccaaagtgctgggattacaggcatgagctatcattcctagtctgaaatcatattttgaattctactgcaataaaggaggaagagctaacattcattatgcctttactctgttgtagccattgttctaaacacttgaatggcagccccatgtggtaaatgttgttatctcctacaattcacagaaaatgaggttaagtaacttgcccaaggtccaaacattagtaaatgatagcccggaatatagccctgaagcctatatttcttaatcaccacaaattcttttcttcttattgatgtgcaaagcaattttataggcaaaagaagagatgtagctatatatttagagtaatttcagttaagaatttagcatgtcacccatatgtttgatttaaacacggccaaacaatgtgtttgctgagtgcttgactgacagcccagatgatttagcaggaagcaatttgtgaatgaaattagataattttagaactgagagggaccatatctgtcatctagcctctgattttaacagttgaggaaataaagttccaacgaagttatgattttcacccaggcaaaatagggagtaatgaatgagctgagacccagttgcaagcttccttatccagtggttttcccccttaacctcatcatgctggaaatgaaactgttggggaatacacacgactaacccttgacattactatcaagcataaagaaagataatcataccctggaaaccttgtcagtggtggaatctggggctagatgattttaggtctggccctgtctattcacagccttccctccagcagcccgtgctgtgaacctaggtagccgccttccatgtgcctgctaagatggggggagctatgccagtacctctgcccactgggtgttgagcccagccttcagagctgccctccctcaccaggactcagcacaactcttgctgtagaccccagtgtatcactttcctattgctgctgtaacaaattgccacaaactaagtggcttaaaagaacacatttatctcacagttctgtaggtcagaagtctgacatggatctcaatgagctgaaaaccaaggcataggcaaggctatgtgcctttctgggggctctaggagagactctctttctttgtcttttccagctctagaggccagccacattccttggcttgtggccctttcttccaacttcaaagccatcaacagtgggttgagtcctttgcacattacatctctctgacccaccttctgtcatcccatctctctctggctttgacctcggcttggaaaggttctttgctttttttttttttttttttttttttctgagacagagtcttgctctgtcacccaggctggagtgcagtggccccatcttggctcactgcaagctccacctcccaggttcacaccattctcctgtctcagcctcctgagtagctgggactacaggtgcccaccaccacgcccagctaattttttgtattttcagtagagacggggtttcaccgtgttagccaggatggtctcgatctcctgacctcatgatttgcccacctcagcctcccaaagtgctgggatcacagacgtcagcctataatctttgcctttaagaactcatgattaggtttggcccaccccatctcaaggtccttaaccttagtcatatctgctaagtcccccttttcatgtaaagtaacatgttagtaggttctggggattatgacccagacaaatttaggatgctattattctgcctatcactcatgttgggggagataaatctccttataccttataaaactatggaatgaattaatggaaaacgtataggacttagtattacaggttgtgggtttgcgtcccagcactgccacttgctacctatctgaccttaggcaagtcacttcgcctttctgagcttcagttcccctatccacaaaaggtgataaatgttatgaaacttgcactctagggctgttgtgaagaacaaatgaaataatgctataagatcccgtagaaatgtacatttgactttttcatttggctcaggtgtattaggaatatgtgaactagtatttagtagtagttaactttcacataccaatatcctctaccctgacatgcaagagctaattaaaagaatctctaagttcatccatttgtttaacaccccaccgttctcatctttgaactaggtaccaagatacaatgacaaacaagatgtggttcctgccctccaggaacttataatgggggagagaggtttgaattaggaaggggcagcccagcacatcaccaaatactaccctaggtgatggtaatgctggcggtgtgcccagagtgatgccaagtacagatgaacaggccatctaaagcacattgaggggcaggggagacttttcagaggaatggatgcttataatgagttttaaatgaaggtagaagctaattaagaaaacaaaagacaaatattctaggagtaaagaataggataaccaaaggcacagacaaatagatagacatgatgcatccagggccctgtcggtaagtccttgtgcctggtgcagatacattcagggacgtggccaaggggagggcagggccagatcaccaaagacctctcagttaaggcaaggaattgagcttatctcaaaaactatggagaatcactaaagattttaagcagaataacataaacatatttgtattttataaaaatccctctggtagcagagagaatgactaattggaaggaagcaggattgtgagcagtgagaacatttaggagctactgcagtgatgcaggaagggtggaggggaggctgtggtttcaagaaatgtcaaaagggtagaccctacagtagtagagcctatagtacttggaaattaagcaaaacatctttgtgatttttttttagacagccttctataggcaagatcagggtttctacaaaaagtgctacataactggacccaaattcataatctcaggaaatagggggataattgcttattggaaagttcactgtggtgtctgacatttctataatcaatgagggtcctaagcatttttcagtgaatctccttttggagttagactccctgttggttttcctgatatagtggaaagtttggcacaagttttagtatctaaatcagtaacattaatgaaagtattgacttactgggtgagtctgtagagaaatagttaagtgcaacttaggcaatgacccatcttgggaggtagggaagggtggtggcgaggggtgaagaaatagcatgtgtttcccaaaactgccgagaaatgtgtccatattgatggtatttgctgattgttgcccaattttcttttcactagatagagtcaatactttttagcatattttaaaaattaaatcatatctacatcataccactgcctataagccatgttattacatttttgcccataaatttggcatgtggcttcaagctctttaaacacagaggcaaatcatgcatcggcctgggagaaaaccacaagtgacattctaagccaacccttccacacaaagggttgagtcatttgtcctgcttgctgaagtggcagtcacccagagaacaacatcctggcctttcatatctgccaagtccttcctatggtcagaaagcctgctccttcctcaaccttccttccaagatgtatggaaatctcaaaagtctaggaccagtcctcaggcctcctttcttatttgcaaagtatacctttaggcatggggattccgcagcttaacccagtgtgtgtgtgtgtgtgtgtgtgtgtgtgtgtgtgtgtgtgtgtgagagagagagagagagagagagcaagagagagagagagaggatagtcttcttctggagttacgtctacaaagtttcccaatatttttcatctcatttcaaagactctgatgttaacagcaaacctgaataataaaagacttaaaaagagattactcctaaaagatgcttaaagaaacgtaacacaaagagagaaaggggcactttaagggttaaaccctcctgtgtaggccacctaccatcaggacccaccagccactgctcagatatgaacagggcaagagtaagatcaaagccagtttactctattttcattcattcattcattcattcattcctctattgaaaaaatatgtatgaaggcccccatggaccatcagcttgaagtgcaatgctaatgagtggctgtcactgtccttaaagagctctcagttcagtgagggaagactggtaagcaagcaaggaattgcttagctgtcatgccattggctgagtaaaataaacctggaagtagtttgaagagaaatcaaaattaagagaagggcactttgggggatttttacaactagccttttacacttaaacaggaagcaccttagatcaaataggatccaatttgaccagttttccaataatatcctgccacctgttgaaacgcaaaataaatatgaccctaggcaaatccaaatcatctttggagggaaatgtatgcaataaatatgaaaaaatcactgatttgtgatttatgaccacaagtactaaatgtttcatttgcaatctcataaatggctggctagagcatgaaaaaaagtttaatttttaatagtttgtttaaaataatatttgtccctatctccttccgttcattcattcttaaccataggatagtacatgcttatgtaaaattaggagaccacagaaaagcatacgaaaatattatgaaaacttccacccaattattaaattaaaaattgtggacaattaagctccaacataaaaagccaaaatggcatgattgtgtgtgtgccctggagttcgtgatggctgattctctgatgtgtactctgcagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacggtactgaaattttcactctcacatcttgaccatctgtcctttactgaacaaggagctaggagggataacagaccaaaggaatcacatgccattttctacattgctcttgtttaaacatttctaagtactcctcgtttttttccctagtgtttctgctttgttcacttataaaatataaatttccataaagtaggggccagcatctactagccttttgtatctttcctcattactctaggaaatagaattctacccacagttgaaacttaacaaatgtgattagttcgtttggttattaacatatcctaccaccaatcaactttatatatttaaccatttccaattgttcttttgggcatgatatatacatacatatatacatacatacccacacatatatacacacactcctccctcaaagctactaaacatgaaaacattgtgcctatatgataaaaatgtcaatattgctggtgatactgatgctgatggaaatgacgatattagctgccattaacgtagtatctaatgtgtgccaaacaatattaaaaattgctgtatatacatgtttgccatttattatttataaccttaacaagatgtctcactcataagactactttgcgcactatgatacagaaatgaatattaaaacatgtgcatgctcatgtcaaactcatagaacttgattttattttggcaggattaaaccaatttgcaacttgagtacaaatgccaatatttcagctagttcttgaaaagttgtgccattgtgcaaaagtcattgaattatttgataactttttaacctaatgatcaaacacctgacaggaatggaattcactggacttgtatctaattgttttacactgttttctatgggttacattttttattgccattgtgacctttatccacacactaacctggaaagtataggaataaaagaattggcattctttctgatacaccctttttgttttcttcttaaagtcatttatattatgtattactcttaaagaatgttttagtctccattttagtagtctgtgcataaggtagtaatacatgtacacaaagaaaaattcacaagcccattcaggtgtcttttagaacattatttaccactaaatatttatacagttgacataatgcttattatgcccttgaataatagaatttgttttgtttttacttcttatccataagcattggccttacattgcctcaagaggaacagaatttattattaaacaggattcttaaatccataactcatattgtgacttcatacattttgtaaccctagtagtgaatataccctaaaaacctataaatccccccaaatcactctactgatgaaaaaaaaaaaaacatgtgcatgcaactctaccaccaccaaaaaacaaacattaatcatttgagtagtttggtggttaccagaggatgggaagggtagtggggagagaagagatgaagagaagttgattaatgggtacaaaaatacaggcagatagaagaaacaagacctagtgttcaaaaaatcagtgtagtgaagaaaataaataataatctatgtacaaccaagtagctagtagagaaaatttgaatgttctcagcataaagaaaagataaatgtttaaggtgatgaatatcctcattaccctgatttggttattacacattatacaaatttatcaaaatattacagttacccctaaatatgtatatccattatgtatcaatagaaaattaatcatttggattaattccattctactgttggcattaagtatgtacaactcaatgtgacttttcctgaattaacttacaccagtgttcattgattcatacattcattcatcaaacatttattgattgcttattttatgccaggcactgttctaggttctggggacataacagtgagcaagacagataaaattcttgccttcaaggggcttacattccagtgagtgatgtggacaggaaaagacatagatatctaataaaatattaggcaataataagtgccttgaaggcaaaatgaagcagggcaagaggacaggaagtgaaggagggcaacagtgtgtgtgggcacagatgtcatggagagggtggttagaaaaggcctctgcagagaagacatttgaccatagctcgaatttagtgaggccacaagccacaggcagatatgagggaagaacactccaggcggaggaacaatgcgtacttttaacacttgccccaaccagctgaactggaacacatgctacctggtatactacacttgggcacatagacaagctataagccctccctattgccgcatctcccctactccagctactccatacaagagctggagacacttcatctgatggccatttggatgggagcccacaatcacttgaagaagttttagtcacactttctcacctgatctcttttcaggcagggatgccactcccagggtgcctgttctacagacatcacttctaaagtgaaacaggcgtgtattttaaaagtctagatttccaggtccccctctagccttgcctcattaggaaggatcatataaaaggatttgtaaatctctccattcatttttggatgcagactatgatgctggcaaacctgtgcaacccacagagttacataatcccttttcacagggatccttgttaaactctcaatttgcctaagggacccagtgcaagaaaagagaaaaggacatggtcctgaggtcagacagaagcagctccagcctcagggcctgcctgtcagccacactggctgtatggttttgggcaagcttccgaatttctatgaattgcaatttcttccactgcaaaaggatgacaccacaacgcccatggcaagaatatgaagatgaaattaaaaatctctttcacaaagtgcctagcatggtgactggtatttagcagttggaaatatatgtctgttctctcttttgtatattatctggtataatttgaaaaaataagggtttatttcctctagtattcaatttaattaaagagcatttattaagagctgattgtatgtgaggcttaggacaaggcattaaagaacacaagatgaattctacactctggactgaatataaataactatgaaagctatgtgatgagtgttatgggggaaaaatgaataaagcaccatgagaacatgattagaagctattaagtgtataatccagataaactgtccacttcatggctctgcttacccagcaccaaatgaagttaaaatgtggttgttagccacctaacaggctctgctttttacactcccaggtaccagagtgaaggccataacagccataattactagttccatttgtacagagaaacaggagctagttgaaagctcagcccaaggagaatatgtgaaattctaggctgaaaacttgaaaacacaaacttgaaaactggcaactcactggttaagtaggccaatttggatggcaaggagaacaaatcagtgcttgatttgtctagtggtattcacgtggctaaaactcctactgaagatggaatcttgctgagcttagaacccccagactgttaggagaatctgcagggaatgttttctgctcagagcaaccttcttaggctcacattttgctcaactgctctttcttgtgtatgtgtggttttttttcctacagaaagtgctatcgtggttaaaatccaaggttattttgatgcatggcaagctctcctcatcaaaccagacatcttctttaagatttcttggctatacaaaaagtatgagaagtctgtgtaagtaatacaactttggaagatttatgagtacaattggattggtttttttcccttgtgtctttgctgtttttcttggcctctcaggtaacttttctgctctctagagcccacaagggagctgttgattaagttgctgatgaaacactttttacagcaatttggctgcatttggccagaccagagagtaaatgaagcctttggctgggcagcttctcggcaagggggctgagtgtgtggtctgggagcttcagcttggtaactaggacactagtgtattttgagttgaagagaagggtcgactgatcctgtcattaatatctgtcaaaattatctttgcacaactaaaaaactggaactacagaatcaatttatagttgtgttgtttttgaatgaatttaacataattcaacttgtaagaactgacaatagtctcaatagaattttttcttaatgagtacaattaacttcaataaaatgtgtgtgggtttttgaaattatgtatcttgtgttttgggggtcctgaaattgtcattaaatgactttgttttggtcttagaatcatccagcagaaaactggacaaatgcccagtggcctacaggctaatcaatgggcttgtagagtacaggtagccagtcactaaacactgctacctctaaccaccagtggaaagcctgtggaatctagaaacaggaactcctgttttgtgtcctgtttctaatggccttgggaagttatttaaaataagatataacctatcttctagagtaggggcataggttaatgagatcatataagtaaggcaattagcatagagcatggcacatagagggtactaaatatgttagtttctccctttcctgtgttcatatcttcctcagatgttcctaaccatctcaagttctccatctctaaatgtccccaagcttgtctgaagacctgactttattctacctgtggattttgaaattcgataatattagtttctagagaagaagccgacttgatgttgttttgtttattctctcatggttgataagtactaggtgaatgttttagacacttggttctttatacatttcatttccaccagagcttattgtgacttgaaaactaatagataaaagattcatctcttccctgtgatcagagttgttggcagtagtggtggtctggagagttcattacatagttctcagtcattagtttagccttggtcttggccattggacccacagaaatttattgtatgagtctgtataacggattctcttaggtttctgcagttccctcaaggagctctctatgaatttagaggctggggcattccaacacctcccagaccatttggggctagtgcccagatgggaatgctatgagcattctcagcctactaggaagagggcaccacagcccagctgagtgaatatctgttctttgtatataagagatgcttagcaaacatttgatgaatgtgtggatcagtagggtatttaagtgtataggtgaacatgtcaattagaatttggaagatggatttattgtacatttaacgtaatacagaacattgttccctgagataagggaacaatacacttacaaagaacacatacacttaaggacagagataagaaaaattgaatttagattaaggtgactttatttttcatccagtctgatcccttcactttaaaaggatgtagggcccagagacttaaagtatcttacatagaaagagaacaacctgaactaggacctgaccccaccccgtccaagtgttctttcaaccacactgccaaaatgcctatacatatttatgcagctggtaattcattcaacacatattagtgtttacaatgtggcagaaactaacaaggcatgagaataaatatcaagaatgatacctagtcactggagtttactgtttagaacaggaatctcaaactcaactgtcttcaggactaggcaaataaaagcagactatgggggccaggtgcaatggctcatgcctgcaatcccagcactttgggaggccgaggtgggtggatcacctgaggtcaggagtttgagaccaacctgaccaacatggtgaaactctgtctttactaaaaatacaaaaaattagctgggcgtggtggcaggtgcctgtaatcccaactactcgggaggctgaggcaggagaatggcttgaacccaggaggcagaggctgcagtgggctgagatcatgccactgcactccagcctgggtgacagattgagactttgtctcagttaaaagaaaaaaagaaaaagcaggctatgggaatgtaagacaagggaatggaggttcctgtggcaaactgaagagcacctgacagcactcacaggtttttttgtttttgtttttttaatttaaacattgtgcctgccaaatcagaaattggaaaacattgttagatttagccttttgatatcaatttttaacccttaactagaagtcacaggcttgatttcgctaccagtatccagaaatcttagctaactctggcaccttaacatgaagtgtagggtctatgtaatttaagggtatttatgaagaaataaaatagtaattcacttactcataagcaccaatggtttcaattaaagcagatcattttacctaaatacatggcaaataaatctgtttcgctagatgtctaaactgagtaaaaatagacaatattttgactttttttccagcaaggatttgaaagatgccatagaagttctgatagcagaaaaaagacgcaggatttccacagaagagaaactggaagaatgtatggactttgccactgagttgattttagcagaggtactgacctgaactaactgtaattcccatgccacatatgttatgactgtgtagaggtgtgtaaagatccccttttgtaactgttgcatatttctgcttttaaatactttctctagcagttctgtaatcccaatccaaatagcccacacattagatatttcagtaaggcttttaagattggaacattctagtaagactgactgctaagattgtgactcttctgtgtaacagtataaaatatgaaaacaagttgggggaggccaaagacactacatatacatagacagtcggcctaatcgttcatctttcagctaaagattgtcatgtaaaatgtccacagtcaatcacagagacatgtggtttctatgatttcattttgttgaggttgttgatccttgagtgtcacctcccctcattttttgaaactttgattcacttttccaaatttttcccatcttccaattgttcagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtaagaatttatcaaataaataatacatcttaaaaacaatttcttctgaatgtccatttcttatgtcctaagaatctgatatcaaacatgaaattttttataatttgctccaaacaataaagcaagacattctgtcacatttgattacaccagatagacggaaaagatagctctttctgtgttcttaatcataaaaatgatgcatgctcattgggaggaatttaaatcacagaatgatgtgtaaagcagtaagtgacatcccccaatcctttccgctctcctctccagcctcatctcccctctccagtggcaaccattgttaatagtttgctgtgtatttgctaaaatctttttctatttgcccacaaacacatatttatggttggatttgtccattttacaaaaacatgggatcatatacaatgttctgcctaccttgtcagttacaaaagacttttgtggactctcccagggaaattatcgtcccagggaagtgatagtctatcatttatagcactgtttctgggcttcaagcagccccttcacaaatgaacttccagtttgtggcagaaggaagaggagaggatgacagcaaagacagggtagtgatacatttccctctccactccaatccagtgatgctagccccttcctctcccctgccctctgcaggggagcttccaggtccacactcaggtcttctccaactctaccgcctcactactctgtctctgcttcaatttcatcctgctccactcttctacagaaacaaggccatctttgaaagaaatcaaacttgctttctgggagaaagcagaattcctcatttgacacttccttcacataagtaatcttttaggaacacatttcttacagatgtgaagagagatcacagaatgtggacttccctctcttgactttacacagaccctgcaaaacaagttatttggttgtagaagggcatcatctttttcaaaccattggagtgctccttgaaatagttaaacgtaagggaaaatttcatcgaagggttaaatatgggagagaagggatctgcagatgcctcacacaggtgggaagtttccaggcaaggtagatagcaaggatacagaataacatctggaatccaaattccagcatgttttcttgagtgcctcctagcaggttctcaggttctgtgccaggtgcagggctacagccttgaacaagccaacaccacccctgcactcacggggctcatggtctggtgggaaaaagaaaacaagctcaatacggtaaagagagaccgaaggagggcattcagagaaaccataagcctttaatacatattgaataccatttatttgagaggtgaaatgtacgtgtacatgttaatgttcccctgacacttcaaaaggcctctgcaaagatggaaaagcagcagagccatttgcaagcgtccatgctccctcctgtgtgccacacacagactcgctaactacttcctagtgagcacctttggtcaccttctccatcatcttcttttctacctcccaaccccagctatacaggccccattagacccttgagtgtgccaagggcagtatgtaagaggaagggccatgagaagactctgaccaaactagacctttcctcagtggcttcgttgtatatgagacagggctgcctcaggaccctgggctatttttcatcctgcaaaagtggcatctctgaagctttaccatgtctgggaataatctaagtctctttgaccagtgtcaggctaatctgagacagtgagggtgtccatctatccccagctcacccagggctgatctgaggcacctattttgtcgtggtggggagaacatccttgtcactctactgcaggtctttcttgatgagatgcagagggactatcagtgacatgtatgggcagatgactgcacaggtaaccagaagagaaaatttcattgaaatagatcaaatctgccatctcactttgactctgcagcagcctgtgcatcatctctgggatggttgtggtgccagtttgctcgtaagtgaagagaggaaatgaatgtcccctacaatttagagtagggaacaaaaactcaaagatttcagaaagcaggcacatgagatgaatgtttgaagcagattgggtgtggtctagatggaactgtatgatgtatgccccctctaaacaggtaattggccactcagcgtcagcccattattgctatgtgggaatgtaagttcagcatcaccaaattttctggacattcagacttttctataaactccaccagtttttaaggtaattggcttcatatctgaatttttataaaaccctctgtggcccaagcataacatatttggccctggttgctggtgtgcattagaattagagccacaatttttttcaaccaagagcaaacggttctgtggaaaaaaatagaagctttaataccaagcacagatggaaactaacattaccttctttgttccttttatctgtttccacaggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgtaagagcccttccttaaaactgagtgtgccactcttgaaaatgtcaactgttaaatcctctctggttctttgtgtttgcaccataaatacttcatttttcttactcattccctctgccacctcaccaggagcacacacgtcccctagcttggagcagggctcccgtattcatcctcaagccttcaaggatgttgggtctccagctctaagaagtatctacatggtggccacaaaataggtcaaaatgtgaaaaagctgggcccttcatttggctaaaatgaagtgatttttgtttaacccaaccaacctacttttccatttaaactttgtcatcatgtcatcacattcagctatagcaccatctgagcaaaggaaagtccactactgcttcagatgaaaatcaaatgagaccaaaagatttggtttttgcaaagtgcctttggctcatcaaatggccccatgagcagtaggtcccattctaaataggacttaataattagaagagagacagtttttctttttttataattgatgtgtactacagattccaccttcattatgtcaaattttaggcaatatgtttttcaatctgaattacgtacgcagttccctaagtgcccttttttcaatttgcatatggtgtagaaacatgatgctaaataattcagtactctaattcattttgtttctacacgggcaatccagataatgctatgtaaatcagtcaactgatcaacaaaaatttattgaacatctactatatgccaggcactaagtccaaatgtggacaagacagctgtggtcctcattaattttctgcataactacaaatagttagatgcttggcactgaataggccaggaatctacatccttgcttgcctttatctcttatatggtgtcacacaaaaataatctttgccttagtgacttataaaacaatagtaaatctgtggctattccacagagctacctgattatactaacacttgctgtaataagatttggtttgcattgctttaccccagcacatgaaaggcaaaactggggactctctgaggttgggtcagaacacagggggtgaatgaaataggacatagaaagggcttgagttccagttgttcatctgaggggatggagggcattgtagctgataaccccaaaacagtgttctgactgacccatgttttcagaatgaatcaaacagagactgagtgactctagcctttaatattctggctaactgtctgatcattttcataggttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggtacaaaaatatcctgggggaaaactgggagtggaagggtggggggtgggagtgagggacatgggggagggcaaggaaaaggagaagtgttggtttgaacgatccaagcaaactctcccagaatcaaattacctgggtagttgttcaacttttcactctgcttagcctgtatagacaaaccccatatatttgtagaggcttggccttggaattctggaataccattggcttttcagtaggctgatgaacacattttgaaaattctattatcttcagaattttgccccattgttaagtgcttaaccgtcactcttgaatgtgcaatgtgctgtggattccattttcatcagttctgaaagaactgcaatgtgtaaattatcagtgaaatgcatgcatataagggctctatcattatcaaattgtaaggacaattgtacccttctatatctttgggcatgctagacacccccatgccttcattgagatcccattttccccctctcaagtggaaaataatcacatccagcaagctctctcattattgagaaataccatttggaaattgccactttttattcctaagcagcacctttcactgttcatgatgctaatgttccacaaaagcatgtgccattggcccactgaaggatagagggacccttttcaatctatatcagctgggctctgggactgaatctctcacctattcttgcagaaagacatactaattaaaccttgtcaaagtagtaagtcaaatggagcgtatgatgctttcagttgctcttagctcaaagaacaaagtcaagggattaacccttcagggatcaatcctgtcagggcttacctgtttcaacttcctcatttcctttctgcagcttttagcaggtattggcctattctaggaagtcaatggccataaccctgtttctaccaggtcaacaagacaatggaatgtatttagacagggcaacccccattcatcaagtccagcccattaagtataccctgctctctcccatcaagaaaacatttcgaagtgcaaaacaaatgagagtcataagaaaatgataattatcataagaataactttgaatccactgtgatttataaccaaaagcaaatgtttcacaaacctcagtattttaatttgttagcaaaacatttcttgcaaagaaggtcttaattacaaggcatggcagctgagtgcctgtagtccaggtaatttttaaagttcctttcagctctgcgactccatgaatagggaggcagtggagccctgcctttttgtaagaatatgctttggacaagctgtttcatctctccatatcacagttttctcatcaatccaatggggataataattatctcataagcattgctgtgaagattgcaagaaataatttctgtgaagccctttagcacagtgctggtacacagcagcctctcactgagcatagggcatgataatgacaagttcagtaattaggctgaatcgtgatctcaaacctcttcttgtgcagtagagggcggcaggagatgatgtgccagatgcttctattatctcatattaggtttcacgacaactttcccatcagtatgaatgcctcagtaatccctgcagcctattgataagacagagtcccaggaggtttggggacttgcacccaagcactcaactagtaaaggagcaacctggatttgagtccacctctcattccaaagcccttgtcccctctctcacgccatctttttgcagcaggactaacctgctgagaggctgaggagtctcattccacttccccagctctcttgccattgtgatgctgggtaaactccttttaagagctgctcattccccatctcattgcccaaggaatttgaagcaaggaatatctcagtttcttcatctatgaaatatggatgattttacctgccttccctacttcccaaatgtgtttcaaggtgctttctcaaaagagataggggaaagtgctgtaaaagtttagttagtataaagtggtagtagtactaatgagtgtattccaacagttgcctcaataggaaattatcagattccatttggccattacctcaccattaggaacatttctagcttcgcacaatttcagttcatttcagatttgtcactgcattaaaaaataaggagtggatttaaaaaatagtcattttctataaacacatagtgtgcaaggcagactgcatcatggccatataattgcctacattttggccaaattggcaaatgctaataagtctattatgattgacagttattatgcaatttcttcttcgggcaaggtttccatatatgattgaaatattcagtccctcacatagttatttccagtggagataagctaggggtttggtgtggaggaggcaaagccagacccatgtgcacaaagtcttcctcttctagcctagttaagcctggatagatgaagaactaagggttgtgaaagtgcattcattctttcaggccaggaaaacagtaactgtaggtactttcttactacattaagcccttttaacagtcatgtcatttacttctctcaacaatactgtgaggtggttattattccccccaatccatccatttttattcctttgctacctgcttggtagagtttcccttccctatccacatataccctaacacatatggccagtgtctcaggttctatgatcaaaaactactcccaaaacattttttaaaaactccttgagaggctgaggtgggaggattggttgagctcagaagttcgagatcaaagtgagctgtgatagtaccactgcactccagcctgggtgacaaagcgagaccctatctcaaaaaataaaaataaaaataaataaataaataaataaataaataaattgctaaatgtgtctacctaagttataaagcatagctaagtttcaaaatgtcatcctcccttacagtagaagcttttggttttctagggaattgcacaaaagcttgataggcatctgcaagctgggcttgtgggaggagaggaggagggaaaggagatggtactttccagatagccctaaaatgatactacctacttcacccacacatgaagctggtccactataatgtggtgtttaggttgcaagggttcccaaatcagaatgcctataggagccaggcaggcaacataaattggacaatcagaccagctataagtagagcctgtgggagacaaggaacatgcctcacctaaaggcattcaggttccgtgttcctgaatgccaggtcccagccaaaccaaacacagtgccagccaaaccaaactcatctgtgagctggattgggcccatggtttaaggtctttaacatcattcctgttcatatccaacattttgcttgcaccctgtcttcacctagtgagaaaaggcagagagctcccaatcttcacgcagtcgaaaactcaagccccagaggagccccaggtgggctcgtccaagcccactcactaggcgacagcatccaggactctctgggcgatcccagctccagctccagggctgtctgatctcacctggctgactcccttgcatagctgtgcacattctcatgatgatctcaatgccctctcaccaatctgatcatcactagctatctctgtaatcatggattacaccagaggagctctacagtcatttccaatgccttcattatgttaagttactattttgcttcatcaacataatagcatcttttccactttgtatctaagccctaatagcaaattgagtgtatacggcactctcaggtcaagcatgcaatttggccattgaaaggatgatttgggcatccagtgtgcaccaactggctgactgcaagcccccaaacactagtatgcctgcatgtatccctaacttgctgctgcagggggatggagatgttgatggaacacatttcattcacaaataattactttattcctattgcaacttttgagcaagccaacgggtttgctgaagcaaataatttttttctaagtggcattggttttatactcaaaccaactgaagcactaagagctcaataatacctcccttccctgctgaaatgaccactttctctgggcaccaatgcctctggcatgcttacaccttctcataatgcagcagctgcttttactactcatgtggctccaaaaacaaccaaaaaacaggcaaggagaaatgaactcttgcttcagagaaatacctgcccatgatgatgcaggaatggttgacacatctttgcgtgtgatcctggggcaagtgtgaaggggaaagaattattataaatcagtcagaccatagaccatgttatcttatttaaacctcacaacaattatgcaaagtatggattatttcccattttgcagctgataaaactgattcccagagtaacttgcctacactcactcagctaggaattttaacttcttggcttattccaaagtctatgataatctttcctgtatgctacactaaaagtgtgctttggtccttttggaaatcaaatatagtataacaataaatgtgtgtagggtttaattggtcaacaatttaggtattaatattggaggaattgaggtattgaggaaactagggaattctggctcctatcataactcacaccagccactccaccatgggaataagtccaagaacagtgacttgagactttgccctgtctttccaaccaacagctaggggtgagtcaaaccaattctattgattcagctatattaagcaaccaaagtaaaatgatccatatgtgttctctagtcatccacgttttactcatctccatgtctggcacacagcatgctctcagtacatttctgttgaatgagagagtgaatctttaaaccagtaagagaagttagtactattaaattcctaagaataggcaccacatgtacacattctaaaatgcggcctttgcagtctactaagtgccactgaaagacagtgaatgatcaatctacacgcttaagcaagaaaaacatggccaggtgggggaagccagatatatcttggtcaggggtactagcagttgggggtagatattcctgctcattgcgaaattggaggagatgaactttaggactcctgcaactgaagattccacaagtccatgggtttgtgcccttctctacaaccaactggtgaggatttacacattttctaagttaagccaaaaagctggctttcgggaacacatagtctcaaaggagacatctttcagaagaatctctcttagcttaataatcagctgatactcataaggatcacaaatatatggtattttgtgtttaataatcacatttgatgcccattggttgccaggataagtaacactatgcctatttacaagactaactcatttccaaatgaatcaaaaaagcacatttcatcctattttaatgcaattgttcctggttctccttcttgagtctcattctaacctctctcaacagcctgtatttctacttctcgcaggtcttttgcggctccttgcataatgaatcctcttagtagttctttccttctgcagttcccctcagcctgtctcaggaccagctctgaggactgtgctctggggaaaccccagcctgtctcccagccccaagcttgccatcttgcccctgttgttgaatgccaccccagcaaacctggggtgtgtttgctttttgtccttctctttcttctacctctgcggatccatcttgcatatttccctcattccctcctgagcctcctgttatccacttcccctttctcttaccatctgcactcaccatcctgaattgctcaggctgaggtcacccttttattctgagctggtgaagcggaggcagccaccctccttttatcacgacaaagtcttgtgtggatgagatatagtccttcctccttatatttgtttcctaaaactgctgcaacaaattaccacaaactgggtggcttcaaacagcagaaatgtattctcttataattctgaaagccagaagcctgaaatcaaggtgtcggcatggccacgctcccttggagaggaatttggtgggagaatccttccttgcctctttgagcttctggtggctgtaggccatctttggcttccttggcttgtggctgcatcactctaatctctgcctctgtggtcacattgcctcctcctcttctgtctgtatctttccctcttctgtctcaaatttccctccaccttctcttctaaggacacagcatttgatatagggctcacccaagtattctaggttgattttatctcaaggcttttaatctacatctgcaaagatccttttgtccaaatcaggtcagattcatgggttcaaggatttggatgtaaacgtatcttttgggggcccccatttgacccactgcacccccagaatagactggcacttctcaatttttagagcagtaatgtctaagcattaatgtgtgaatcacctagtgattttgatacaattcaagttctgactctgggtgtgagtagcgcctgaggttctgcatttctaacaagctcccaggtcacactgatgctgaggtaggtggcccacattttgagtagcaaggtgagccaaaatgtgtagctgtgtgatccccagagcagtcgcagcagcaccgcctgggagtttgttgtaataggaatgcccaggccccacctggacctgctgagtccaaatctgcactgcaacaagatcctcatgcgctctggttgcatgttaaaggctgagaagcgctgatctagtctagaaggtttttttatcttcatgctttatacccaagacccctcttgatcacattctgcaccctatcttcgtggagtcttcagccttattggggcaggtcttctgcagccctgcacagattataactcctctatgcccctaagtggaagcacttggaagacaattaacgtcttcccttgcacactgttctattgcataaatgtccccaacctacaccccaacccaagtagccatgtgtcccaagactgttaagtccatcaagccacaacagctgtgacaaatatggaagctaccaaacaggattttatcctgctcaaataaatcactagaaaattatcactgtaatcctggttttttttttttttttttttttgatacagtgatcaactaaaagtgctttttccagccgggcatggtggctcgcgcctataatcccagcactttgggaggccgaagcgggcagatcacctgaggtcagcagttcaagaccagcctggccaacacggtgaaaccccatctctactaaaaatacaaaaattagccggatgtggtggcaggtgcctgtaatcccagctacacgggaggctgaggcaggagaattgcttgaacctgggaggcagaggttgcagtgagctgcaattgcaccaccgcactccagcctgggtgagactctgtctcaaaaaaaaaaagtgctttttccactcttctgaagttcccatcaaactctttactcataaggattcaaactatgaaaatgtgtctcttctttcatcccagtgaattaagaatggatattaccataattaaaatcttctgttaggtatctgacatcattactcatgtggtttctttgttcatagaatttcctctggaggagaccctcctgccaccctacctcctattatataggagatacataatcaggaaaagtttgaacttggtctacttagaattaaattctactgtttaccagctgtgtgtcctggggcaagttgcttaacctcctacagcctagttttactcatctgtgaaacacatgccccacaggattcttccattaggcagatcttgagtattagaacccagcatgtaaggggcagcaacgatgttcagagaatgtctgtttcctttctttgctcttcctttggtcctcttctcttcacgtggctcttaggaaaatgaatacgccaattacatatttttgttttcttcctcctcctccttctccctggcctagaggtctttcaaatcattcattttgaagagaagactgttcctgatctggtctttaaaagtgcatgtatacttttctccacatcaaaagaaaactatgtcaactgaaaaaaaaaaaaaaactttgaaaccagttttataagttgtcagaatgaatttgggaattttctactgcttaaataactccatcttatagcagaaataatttatttttgacctattcatttatttcttcaacaaacatttattgccacatactatgtgctggaccttgttcttagtgcctataactttgcactctatatgtcaaaacagaactaacaaataaggtaacaaataatgaaacacatcatttcagatagtggcaagggctatgaagcaaataaactgggtaatgagatagtaatgggggacggggctctattttggaattagatgctcaggtaaggcctccctgacatattgaagttaagatcaaactgacaaagaataaccagtcaagatctagagaagaaagttccaggtggagggaacagcaagtgagaaggctctcatgtgagatcaagcttggaatatttaagggtgtatatttgagacggaatatttgacacaggcagagtggctgcagtgtcatgatcagagggaacatgaaacaaggtgaagctggcaagatggacaaccacactgggccgtgagggtctcagaaggaagctggattttaaatagaaagagttgctggatctggctcattctagctcatgagagccacttgttaagttttcagggttttaagagctgattaatgtcaaattgatagcttgaaattggccatagtgggagtatttacaccatgataattggcaaatacaacaaacccaggttcttctcccagatctctcctccaagagagccagttgttaaacacttaccagaacaccgctggtgtatgtgccatttaagtgcagtcggaactcactagagggtttaagccggaggatgttatgacctaatatgttttaaaataatccctctggctgctgcacggagaatggctcctggaggatgagaggacagctggggcgggtgtgggaggggcaataagagagacttgaacagagcttttctgacttgaagtcctgtgttcattttactatcacacaagacagacataactgatgcccgcacttagtattcttttcctctttaaacttttgctctataaccagctttcttcctcacttaaaattaccatcagaccagacttcacatctgaatgtctcaaatgagtcagagcttcaaagaccctcatacagattctggaaataaaaatgactaagtttctttaggatgaaagaacggcaccttttcttcttggaaattaatcatatctcagggtctcggggaaattctttatatgattttactacgttcatagcttaatggaaatttctggctagagtgggcacaatccaccatctacaaaccctgaggtattagaagttaagaacgttttgtgtatggccacacagctatttagggcaatatgaggactggaagctcggcctccctattctcagtccaggctgtgctcagtaaagtctagctttccctgccaggaagctcaggctactggctgccagctgtagggctgtttgctgcctctgcagtggtgccaccaccccagggatggggtttaaatctcagttcagccctggaggccgcctcccagcagagggccctgccagcctggttctggccctctctcctgaaccataaagcaagaccgtatctcagcctgcctgtgcaaggcaaggcagaaatggcaaaagatgccttgcccattgatgaatgaagctgattttttcagcacttccctcctctgaggtctggacgtgggccagccttggtctagttggcctatattaaagttacttttttttttcctgatgaactatggttctattcattaggggggaaattggaggaaatgaattggtacataagttttcaagtcatccttgtgtttctaagggactggcatcgagctctcagtaataacacagtcgtgagatgcacagatgggaagacgtaaccctctttttttttccctttctaaaaactttttaattgtgacaaaatatacataacataaaatgtaccatcttaaccattttttatacagctcagtggtacttgtacattcaccttgttgtataccactcacagcagaactttttcatcttgcaaaactaaaattctgtacccagcaaacattttcatttttccttcctcccaaacccctgacaaccaccattctattttctgtctctatgaatttcatgactccagatacctcacgtaagtataatcacataggatttgtccttattggcttatttcacttagcacaatgtcctcaagtttcatccatgttgtgacatgtgtccaaatagcctttctttttaaggctgaataatgtttcattgtatacatatactacattttattatccattgatctgtctatatgcacttgggctattgtgaataatgctgctacaaactttcatgtacaaacatctcttcaagtccctgctttcagttattttagatatatagccagaagtggaattgctagatcatacactaattctctttttcatttttttttgaggaactaccatactgttttccataatggctataccaatttatattcccaccaacagtgcaattttctgtttgtttttgttttcttaaatagtagccagcctgatgggtgtgaggtggttgaaaattgacttttttctttttttaagagacgagggctcgctctgacacccagtctggactgcagtggtgcagtcatagttcactgcagccacaaactcctgggctcaagctattctcccacctcagcctcccaagtagctagaaatacaggtacgagtcaccatgtccagctaatttaaaaaaaaattgtacagacagtgtctcctgttgcccaggctgatctagatagtggtagctatgcccagcagccagactaggcaagaagctggtgagatgtccctgttatagccaaacccttgccttccttagctggactcctcagacctggctacacagcctggcttctgtctctcttgtccaaacaactgatcctgtagcctcaacttgggcttgaaaagctacttcccacagccactgtcaggactccatcttttaccccacatcctttaaatgctggggattaaccacagctctaaatagtttgttgtcccagaagccaagttcatttacatttattttaagtaagaaattctttatgagtggtgtacatatattgtgtggtttcttggaaaatgcaatatgtctgcaaagtaattttgttatcatctggctaaaaccctttatttgttaacccatggtcttaaataacttgtttcagttcatattactgaggtaccatttatagagacaaagtggagccaacagttgagggtgttttgctgtgattgagggatggattaggaaaggtgccctgaacctggccacaaatgcaggtgcaggtgcaaatgcatagaccctgggaagcacagggaagattataaagtgagaggaagccctgtttcaagtgcccagctcacactcttgcccgttcctgtctctggcccctctgccactggctctcccctctctacccccagttcctagatctgtgatctgtgcctccatcatcccttacctctcctccagatttgtctcttcccatggtttagacagggcagcagatgcggaatgaccatggtggggaaaatggctggatgaagctggaggatgtgggctgaagaaactggagggcatgtcacatagggaaagcaggtgagaggaagaaagtgggttacatgatgggacagaggagggacaagaaactaaagtagattcacaccaggaccctctgaagcatgtgtgccagagacttggcatgttggccagaacttctagaccactggatcgtctgcacgacacagacaaacccatggaagccagatcctaaaccacagggctgccccaacatcaaaggcaaaatggcattatttaggagcccagttatccttggaggtctcagctagattttgaaacatatatataaagttttccaattatttgcttcacataatttttcactggctgtcttacctacacctgaattgacatagtataatcctaaaattatgttgttagtttacacatatctaaaagattccactacaattctttccgtaagtctcaaatgattaaatgtaatcattaatgtaatatgatcattacatatcactgtaatgataaagtttattaatgtgtatcaaaggttcccaccagctacccggcctcacattctttcaggagggttgattattgtcttcccagggtgctggacatggtacctggatgatatctctgttgtagttaatcctctaatgcttggctggtatctataattttggtgctttacaataaagaaacgtgtgtccctgttcgctatgctgaggaagactcctatctaaggctgtgtctccagctacctgggactagtgctgctcagttcctatgctgcagctactggtaccgcaaatccctcgccgtggtgcaatcacacttgatccacatgtgacccacgtgtgaaatgaattttattacatatgatttcggagttgagctaagtgcgaggtgtgatgtggtatagtgtttaggggttgtgactcctaagaggaaggggcaggaacacagggcagctatgccaaggacacccaggggacatgcaggaacttcgtctttgattaaaaaaaaaaaaagcgagcctgatcaggacagcaaggactcttttcaaattgtgacccaggtgactaaatgaatagagtcacaactatgtgtgcctttggaaaccctctgagacaacctcatcatgtagttgtaactacactgtgactacactttaatttcatcataactttcactgtctttagccgtgtttggggtccttgattactttaataaaggcagtagtagcatgaagcacactgtgaacacaggaagttaggaaatcattggctcacatggagccttttaggccagtggcctctgccgtgcacagcccaacactatttcttattcatctctcttcaaaattgtccactgaaggcaattccaaaaaaaaaaaaaaaaaaaaagccattccaaaattcttccaagcagtggcagcatcattagaataacagtatgatccctaaatttaacgtagaagttctggtatgtctactgaaaaccaatattattccattaaaatcacacttcattcagggggttaggactgtcttttccttcatattttcagggtgtttccaaacaagaggatcattttgaagccagattgctaatgtacctaaaacattaaatataatgtgaaatccttattttctaatttaaaaaatgtaattcactttgtagctgaaatcaaaacagaaacggatgaaatgcagttattaaaattcaaagctgaaaataagtggaaaataggaaagataggtgatgagttgactactgtcccataagagacagcccctgtttgtggccatttctggacatgtttttctcaataaagtaacatggatgtgggcttttagggtgagtaaagtacagttttataaaaattttgtaatgtgctagtgttcccgtactttttactgtctggtatcctaagcatgaagcatgtccaagtttaaagtaggaaaacaatagtcctagtgatgccgagaaactcaattattcctcagaatgccatggtcatctgcacacaaaatgtacctttaatgtgactgtgtaatttgtaaagttgacaaataaagtgctatgaatactcctctcctctttgtggaaactgtctatttgttaaaaattattatccccactgatgtccttcatctccagagaatacagaagtaagagtggcttagaccaggtcttctcaaagtgtacccataggctggggctagtctgcaaactgtttgagggttcctggtgagataaacatagatacaaaatcggtgtctagaaaatttacagcaatttgacaacagccacatcattaagcacatcaccagaggatttgcctcatgaaaaagagtagaggctgggcatggtggctcacacctctaatcccagcactttgggaggccaagccaggggtggatcacttgaggtcaggagtttgagaccatcctagccaacatggtgaagccccaaccctactaaaagtaccaaaattagctggactggtggcatatgcctgtaatcccagttacttgggaggctgaggcaggagaatcgcttgcacctgggaggtgaaggttgtagtgagctgagatcacaccactgcactctagcctgggtgacagaacaagactctgtcgaaaagaaagaaaaaagaaaagaaaagagagagagagagagagagagagagagaaagaaagaaagaaagaaagagaaagaaagaaagagagagagaaagggaaagaaagagaaaaacagagagaaaagaaagaaggaaagaaagagaaagaaagaaagaaagaaggagaaagaaagaaagaaaaagggaagggaaggaagagtagagactagttttggtggtcttcatttcattttctaataatttatttttatcgcattttttaaagtgtcagtccctatgggttgaaaactaagaaaaataatttgtccttcaccccaggaaccctgccttaggctctgctgaggctgaatatatgtgtatatatgggtgccccaaaataaatacaaaaattctctggaaagtcttgtttctttagaaaacaccagggttgaacatgaggtcacattaatagcaatagtcacgtacggctggctgtacctcccacccctgctggcacaggaactccgacccctacaacatttcccttgggaatttctgggctcctcaggcatccattcctggaccacaacaactttatgtgcctccccagagttcctccgctccagcttttctgggaacttcagccatttgctcaacagaaagtgccggcagctcccttcccctcatttcttgatagctctcgctgtctcagctgtcctgggtttggacttgtcaggaagtgagaggcaaactggcctcaagaccaagaagcacaggctagtttctttctgaaccataagattcccattcttagtgaacagggcctggggacctcatacaaagctggctcaggttgggggtcagggtgggcagctggagttagcaagttgtctggccacagggggatgcaggtgagcagggctggagatgtggtatgggcactggggaagacctttggggagagaatgtgagatccagcgaggagacctgcttagaggaatctttaaagagcttacaggtagagatttcagatcgaaggaccattagacgtcatgtagtctaatgcctccttttacaaattaggacacagcttcagacaggatacctgccgctggagtaggtgacccttggacaagaacccagagccccctgaatggtgttccaatgcttttaaagatgatctctaattccccaccgtcctcccccaagccccactgtttccaccccacatccagtgactacacaaactagctttgccaggagagcaaccaattttaaccagcccatcctaagacattcctatatgtcagagcccaggtcccagtttggggttatggcaattcaccactcccctacaattacggaagcccaagcagcagccggggtttcactcagcctcgctctcttttccagggtgctcttgcaaggagtcgggagagagccctgctatgctcacatccgccagcagggggcagatagggaaaaggtttaccggctttgaagccgggcagctcccggtagaggggagcctgcctgccttggtttctagcagggctgctcactgaactgggctgcctgccaggggccagcagtaaaaagccagtcaggttggtattactgtctggtaaaatgaaaatacccctaaatgctcatttgctccatcatttcagattccctagtggctggctccaatccgggcacttgagtttacatcataacctggtcgctgaagagctgtgaccttggggaagttactctgtggtttccacatttgaaaaagcggagaaccatagtgcccacctactggggttgttgggtgaaacaaattagaaatttcctgctatgtagtaagtactcaatacatattagccagcaataatacgtgattttacttttaactcatcctttaaacaagtatttattgagcatctactatgcttaaggccctgacccaaacaagcgtttagaagacagaaaaattaataagacgctccttcaaaaatgttacaattattttctatcatttatctattatcaacactgtaatctcttatttctttgattgcccctgttatgaggaagctcagcaccaaagctgaaggcctatctttgctgctcttttgatcctcaggaccagcggctctacatgcttcttttctgttggttctcgtattccattctattttatttattaagtcactgcatacatctcttgcctgacctgctccatgccggggtctgggcttgctgccttactgatgggagtcagagcggagcactttggggaaaggaaggccactaacgggtctgggcttgctgccttactgatgggagtcagagcggagcactttggggaaaggaagtccactaacccccctcccccaccttccccccaaccaccggcaaaaaaaaaaaaaaaaaaaaaaaaaaaatttttacaggtaaggaagtgactaacgaggcctgaggggatgagagacggaggagaaacagcaacaatgaaaacacctctgagaaagacaggatcggagactctggggaaagaaagaaaacacagtgaaagtaaagaccttgccaagggccagcccatcatgcgggcagagaagaaaagaaagggacaaaagaaagggacgatgtggaagtgtgagctgaaaagcacaggttcagaaataagttgcttttagtatccatttcaggagcagagcaagggacagcgaggccaactagcgatagatttcccatcaagagacagagaagggcagggggtagaaatcactgtttccggagtggaaaaacacaactgagtgtctgaagggagaaagtcacagcgtcagctggctggacagctgagtgtccaggttcaccggccagctcgggcagctgctttcgtcccctcacccctgagccagtctgtagccaggatgtaaataagtcacctgcatatgttaaaaatataacaggacagccactggccttgctcagcaatgttgaagaatcctgcagatggaatggtgcacttcaaggaagagaaagtacaaaagaaaaattgctgattatggcaaaggagataacaggctgattcatctgttaagcctgggtcaagaaaatgtcttggccaaacaactgaccacttttcttttaaagactaagaagaccccataaaaatgtgcacctctgttggccaaaaggtatgtgctggaaccatacattggaaactgcccccaatgtctgccaattgcagaatgggtgaatacattgtattttgagacagcaatgagaatgacaaacttcaactacatacaacaatgtggctgaatctcacagcagaacgttttggtttctgtgccccctcccaataataaagcaagtttcaaatatatacataaaattgtttcaacatttctttacgccatataaacttgcagttgttttgacttctttgaaccagttgtaacatcttaccagttccctcgttcaactagggagttaaataaaatctttgatatgtgttcattgtacatttccatgagaaccatgattttacttatttaaaaagactatcctctatcacatgggaagaggtcaggttcagatgcgtggcccctgggtttcctgaggaaggccccctcttcactgtaccatgatctgctggcaggaggcccagtggacctcatagggcaggcgtgaggccagggcccaggttggccttgtcctccgcttcctggccagggttggcatggacagcggaaggcagagtggattttggaaggaactctgcctggcccaaaggcaataaacagtgagcagggaaggattgtggcaaggccagagctgcgggccccatcatgggctgcccaggggctgagggaccaaactggattgctggaatttggtggtgcaaaaaaagaaaacaatgtggctaactggggaggcgcaaacacaggatcctgaaggactgaggtttaggttcttctttccctgtcccatcacgcctgtacaggaatttcttttaagagaagaagtagctagtgatggcagtcgtaatggctggcatttattaagcatttgttctttgccaggcaggatgcccagggagcagcatgtcctgtcatttcattcctcatttatcacatgctaaaggcaaccgtatgagggggtgcatgttactgcctctttctagctgggaagtgacaaggagctgggatttaaacccaggctaagccaatcagccccactgtgtgtggagcaggctgagaggcctgatcctagatgctaggatgtgagggtggatctgacgtgctggcaggacctccaggcagcactgtccagccagaagttgaaatgtagggctgatgctaaggagaggtcaaatatgttattcatttagcatatattaatagaggttctcctaggaaagggaactaggtcccttttctagttctgtggtctgggcaaattaacaaattccccaagtttcatttcttcctctttaaaatgtcagtgataccacagtacctatttcctgggttgggaaagggcagtgtgaaaattaagtaaggtgatatacgtgaggctcttggtaccacctctgccctgaacatgtgataaatggcagctattttcattgttattgtccacgagagactgcagcttctggtggaggatgcattgagtaagtgcttgtggctcttgggttttttgatcaacagagcactattcatcattattattttcccatgacctaaaaaacacattgtaaccctcccaaggtgaagtatagaacgaaactaaaaataagtcaagttatcattaatttaccaaagcaaaaagtaagtattttacaattcttaaccacaggaacaaagatgcataaggaatctctttctttctttctttctttctttctttctttctttcttttttttttttttttttttttgagacagggtctctctctgtcacccaggctggaatacagtggcatgatgttggctcactgcaacctccacctcctgggctcaagcaattctcccacctcagcctcctcagtagctgggaccagcaggcccagctaattttgtattttttgtagaggcagggtttctctatgttgaccaggctggttgtgaactcctgggctaaagcaatccgcccaccttggcctcccaaagtgctgagattacaggtgtgagccaccatgcctgcacaggaatttcttttaagagaagaagtagctagtgatggcagtcgtaatggctggcatttattaagcatttgttctctgccaggcaggatgcccagggagcagcgtgtcctgtcgtttcattcctcatttatcacatgctaaaggcaaccacatgagggggtgcatgttactgcgtctttctagttgggaagtgacaaggagctggatttaaacccaggctaagccaatcagccccactgtgtgtggaggaggctgagaggcctgatcctagatgctaggatgtgagggtggatctgacatgctggcaggacctcgggcagcactgtccagccagaagttgaaatgtaggactgatgataaggagaggtcagacatgttattcatttagcatatattaatggagggcctattatgtgtcaggcactgttctaggctgaataaaacaggcaaaaatccctgcttccatagggctataatttcagtggagcatttagatactaaacatcataaataagtaaaacatatagtatgttagctagggataagattggtagagaaaattagagagagaaaggatacagagagccaggggtgggggtagagtgtgcaagtgtacttagggtggtcagggaaggcctcatttaggggcatttgtgtaaaacctgaaggaggtgagggaataagccatgcagctctttgggagaagaacattctggatggcgggaacagcggtgcaaaggccctaaggtgagaggacacttgtcatgtttgaggagcaacaggaagccattgtggctggaccaaagtggatgagggcacgcatgttagagacgtgttggagagaggcaggaggtgcagacccagaggggccttctatgctgagtgactcgagggtggtcctgagcagaccaaatacacgggctggcttaggtaaaagaactattctggtcacttcatggacaatgaagtctagtggggcaggggtgacgcaggaaatcactcagcagccacttacagtagctcagacaggagacggtggtagttggaacagaatggcaagggcttcgggagaagtaatgagattctgggatttgggagtcttcagaaacctttgagactatcctttgaggggtattccaacatgtggcctgatcccaataacctttcttggaaagccctctcctggtgtctccaggataatggaacacattacccatgaaaaagaagcctttctggcccctaccacgtgtccgggcaccgggccagctttttctctatccaccagtgattctgggcccctctctaagacatgaacagtggcaggtaatgaacatcgaaagccccttaacttcccctcagattttcctcagaaacaaagcaaatgccaccaggagcaatgttccagtttctattgttgctttaaaaacaccctaaaactttacgacataaagcactatgttcttaagctctcggattctgtgggtcagtaactctgagagggtaccatgggggtggcttgtctctgccccattatgtctggaccctccactgggaaagctcaatggctgagggtgactgacggatgacaggggctggcatcacctggagctgtccttgctcacgttctggctgtcggctgggatctcagctggctactgggcagaacatctacacttggcctctccctatggtctccttgtatagggtggtgtgggcttcctccacgccacagtagctgggtctggaaggcctgtgttatgtgcatgagacctgaccctgcagcagccacctggcaaacaatggagataccagaaaacaaagttgccatgctgcagatagcaagatgaggaggtggaaagtactaggggccctgaattaacctggggcactctacctcaaatttcctgtttggtgaaatcaaatacattttctgtattgcttaaaccagttcaagttggggttttctgttattgccgctaaaggcagcataactgatacagcactcttgatctgccacgtctctgtggctgcatactccggagaaggaagccagggttggagcatcaccacccacaacaactgatgtcctgctgccagcagacagctgctgcttcctggggcagctgggatcaggggtccctatggtggttcatgcatgagctgtcaagacatgattctcggcatcttcccccataaaggcaaggaatcaattctttgcagttctcaagaactcacacccagggaatggaggtgggggtgtgtggggagtagttctgatgtgtggtaacttgatggtggtgaaacaaaaaaatggaaaatactaggaggagaaaaccgttcagacatggccccatcactctaactcccagggagttgctcacctgaagccgtgcgtatggtgaaaaaagaggctgttagtgtcccagacacatccctcagacctttcagtggacttcagccaacttcaaactgtgtgtctctatgcctgtgcctgggactttttccaaaactgtggaaaacccctcaactcacatgcaacgaaagccagaagtgggggagaattaacacccctagggagcagacttctaccaatgcacctggaagctgctgtataaacacccccgtcctctccctcgggtggtaatattctgaggtgtgtgtttgatattggtttccagagcttccccacaggactaagctccatctgcctgctatgagagctggtggaactgcatcctttgttggctgccttccttcctgaatcacttccccatttccccctcccctactgacattctctgcccctcccagataaattgcctatgctcaaatctgtctcagcatctacttccgggggggcccaaactaaggcagtgatcaaaaggaggtggttggttgaagaagatgggaaaagattgacgataatctctgcaggatgaagtgacaatcgagccacagggttcttttactaggaagctccagaagtcatgaaaccagggctttttttgacttgccaactgggagatgagcctcctaaattttcaaggcccgctggtagctcacgggtatctagttgttgagccttctgtatgtacaggggccagggcaccattaatgccattccgattggatccaatcccaacagcacccgtgagcagcatttcacactgatgatctgctcatccgctcatctcctatctccctgcagctgaggaaacctctcagcagtgatcagcatcgagaatggatcttcttttgttcttgttcactcaatgtgtttattttcaagattgcatttgtggaaagcatttaaacagcaccgtttataagaaaacaaaagtcaccagatggaaaaatagaataagaaacacacacacccacaaactccccaagcaatatagccagggcagcgggagttattgttgtcttgctgttgtggataatgcagctgtgttggaaaagctgtctgcttttgacagcctagaattttcaagagggaactgaacacaggtcaacagaattctgtgctgcaattcacttcttgagaaagtttgacaaaccttcctcttcctcctaggacagaacaacagctactagaattaccatatatgttgaattataaagcacaggcaagtttctcttgcaataatgccttacagttggcccatatcttatttggacagataacgttctttcttatgttctcaagagccttagcaacacccttagccactgactggctgcacagccaggctgatatgaaaacaagaaagatagcggctgtttctgaggctgagacaaacatcacctcctccccttgaggaaatcaagaaaaccaaactgctttcccctctccccgactccaccatcaaacacaccatgattttgcctataccaagggttgaaaaccttcagcaatatgccaactttcagtcacaagtaactcctggccatgacttcctccctgccattccttctcccaatagccaacatgggagaaaaaagatggcagtgtgaaaagatgctcaagtcaggactggtgttctgggtcctgtgaggaggagtcttaacattaattttacctggactgatcttagctggacccccaccctccacccacagccattctgggtgtggcgtgctcagaagacggcaacaggtcgcagctgctgcagcagggggatattatgcagcatggctgccctggcagcagtcagggagtattgagccccacactcagacagacacttaactgtgtgacactcaggagtgtacttaacctccctgaccttcagtctctccaactgtaaatagtagctcctacttcacagggttatcttgaagtttaaaagcatataaaatgctagtgccggacacatcatcagctctctataaacggcaactcttattaccactgtgggcattcgactgtggtttataacactgtaagcaagtatggactaataaaagctgtttccacagttgtaagttttaggagctgttaacatgattccaactgcgggtctgagaacccgggatgactgttagagaacccaattgagatttcacattagagaactgatgatattaaggaaaagagtcgtgtgcaggccatggagtggatggtgaggacagccagagagcatggggaaagttaccagaaggcccggctgccatcaggaggactttccaggggagtagcccactcagcatgacacggatgcaggagccagaggaaaaactctgcgagccttggagcagacctggcacgtgcaggtttattgaccacaaagtcatgagaaagagattttacataagtcgaggctatccgaggagaaaggaggttaagaccacagcaaagccatctctgtttcataccgagtgtcctcaccaggctgggccttcccgacttagctgggaggaggtgcaggagctgggcagcgaggtatgcacacagctggatgtgccaacgtcggggccgaaactcagaggctaaggaagcttctgaaagagcaatgtaagtgctcccggggacgggtcctagagcgtcctccattggaattcatgtttctaaagcatcgatctgaatgttattcaataataccatgccctttcccctccacacttttcagacaacaggatgaccatgcacagctgggaagcaacactttgtaagcaaactccagagtgggtggcttctttgaggaaagagtgaaaatagataaagatgttgcggggggacagtgtggaagagctcccctccaaggatatgctgatatacacctccctggagctgagaagcaccgagaggagcctggaccaccaatgagcacccagagggtggaagatatgccaccatgagctccttgaggccaggaaccatttccaatccacatatcaactaatttatattggttaaattataaaaagccattaatttttcatgtatttattccagaagtacaacttctcttcttttgctccgtcctccatgcacacaacacacagagcaaatcccacattttgatggatgactgaatgataaataatatagtactgccttctgccctgaagccccgacaacaacaaggctacctctggaatccactcgccacactgatcatgactgtgccatcagggtttgatctcggtctatcacgtgaatctaccttgttttatgggcctgcaacataatcagagcaaaccaatggatttcccttaaagaaggagcaaggggaatctgtgcaaaagcctagtataaatatattacatcctggaaaaatagactatcgtaaaagtctatttaactgatgaactccactctgaacaagcaaaccacaccctttatcaacagcttgttaaggtccttttattactgccattacctcgcctgaaatagccctcccagtccatggtaagtaatgtcgtggaaacagcacttattctggagccagacaggaccgggttcaagccctggttcacacttaccagttgtggatctctttcctaatttggagaatgaggataatactacctacattatggagatgtcatgaggattaaatgatgtaacttctaacccccaggttttacagcttagaagcctaaccatagatgattctagaagacaacctccttgccaggtcacaaccaaaccatagccagctgaatgaacgtagggagctgagtgagcatttttgggctccaagtctgtagcagggaccgtaagggtgggagggatgtcagtgggaggggactcatgatgtcttaagacctagataaggggtgggagcagaatgggagccttccccaaatccattttccctttcttcctcaccaacaaaagcctggtactcagggtttcaatgtgaccagaagaaaaactatattctgcagcctaccctatagataaggatggccacagaactaaattctggccaataatatataggcataagctactgaatgaggcatttgggaaagctccttaaagaaacagcagattcatctgggaagcccttttgcatttcctccttcctttgctaattggaactcagacatgaggacaggagctgctgaggccatcttggaagcatgaggcaaccctaaggatgagagcacagagagataaaaggtgcctgtggtagcgatctccacctccagacttattttatgtaggagaaaaataaagccctatcacttgtttcaggcctgttattaggggagtttggtagccagcctccaaggtggctcccagtggtcctcactgggaccactgggaggatttgtgctcttgtatagcccttccacatgttgaatagaactgacctgtgtaaccaataggatattaagaaaatgacaatttgtgatttctaggtcataaaagacatggtgggttctgccttgctttctcctggatcactcactctaggggaaggcaactgccaggtcatgaggacatgcaagcagccctacagaaaagtccacatggccaagaatcaaggcctcctgccaatagtcagcatcaacttgccagccctgtgaatgaacacttggaagcagagcccctggctcatgaagctctcagacaactgaaaccccagtaacatcttgagcacaatcccactggagaccttgagtcagaaccaccaagtaagctgctcccaaacttttgattcataataactgtgtgagataataaatgtttattgttgttttaaggcactaaatttattatacagtcataaataactaatacatagacatactcaattcccaactgatacggaacctaaagaggcaacttggaatgaccacacatgacacccaaaagacctgcactctccaacctgctgaaatcccatccagagaggcacagcttccctcctcctctcactgcctccatctggacatgtgggagacatgcagcacccttcctgtagactgcagacactggtgctagctgtaatcaaagaagtcagtccatcctattccacttgaggagtgatctcagccggctctttctcctcccaacttgcccaggtgcaggagttctcagcctcacaccacctcacccctcaccaccccagccccaccatctgttatatagtgggcctccagagttctgggccattgaaagtgggttgtccatgggtgtcagctggatgctgagccaagtttgggggaacggagtccctgcagccaactgcctcttggcggcagtcctcattggcctcctcagtagacaactagacatgttaattgaaactggttcccttgtgatttctggaactagagaattgagctggaaactcaagttattttccccaaagtcatgaaaattatttccaatatgaggggctgggaaatatgctcatgtaattcttgaaaactcttcttctgtgtaagagacctttgaaggtgaaaccagaaatgtgctgctgcttgttttctgattctttcccctcaaagaagatgctaactcttccctaattgccattagaaaagagaagaattgttctcattccctcccttccattggcagagaggaatgtccacaagatagaaggaaaaaaaaaaaaaagagcacatggtagaggtagaggagaacatcaattaagaatacaagttgtattagttggagttctccaaagaaacagaatcaataggagggaggatagatagatagattctcaaatgagatttattataaggaattggttcacatgatgataaagactaagaagttccatggtctgccatctgcaagttttcctccttacccaggaaagccaagggtgtaaactttagtcaaaagacctgagaaccagccactctggtggtgcaagtcccagcctaagggtaggagaagacaaatgtgtcagctcagcagttaggcaaagagaaagaatgcgaccttcctctgccattctgttctacttaggccttcaaggggttggataaggcccacccaccttgggaagtatgatctgctttattcagcccaccaattcagatgttactctcatctgaaaacactctcaaaacacacccagaaataatgtttaactggctatatgggcattccaagccctgtcaagttgacacctaaaattaaccataaataaaagcttatttatggagcacatgccactccttgatcacacctgatgctctggggacaaggacctccgtacacatccacacatccaaagatgttttctcttccatcctttcttcaatgcttttctgcccagaatggtcttttctcagtttcatatgtggctaagtcctactcctacattaagactcagttggagccacctctcaggatgtgtcaggagccagtgctgcaggctcccatgatccccatgctctcacccacaccatgttgttctcataaccctctatgcactgaccaccatgcttacatcactgacctcttaggcctctacccaccacattactctggggatttctggagaacagaactttcacttctgtcttcccaaaaccatcgtttagattctagaacggtgcctagcaaatagtagatgctcaataaacgtgtgatgggtgagtaaattgattggataaatgaataaatatgtaatatgcactgcacagtggaacaccatcccacccactccattttatttttttaagctttaaacattgccctcgagagagatttaggggcggctccctggcccgataatttcccactcttaaaactggtccttaaaccaccacactcaggagcaagaattccagactacttcatttttctaactcaaaataatccagctttgacgactctccggagtggtgagaaactcaatctcagtcacatttgggggtgtcaaagtataatttcaaaatgctaaaaatgtaactttcatataaatatataaggagcatgtgtcaaaagatttacataattcattaatgagagaaggcaggatgaaaaaaactggctcaaaggatgacacaaggaaatgatatatatagagagtcagtgataaaaagagaacaggggaatgagattgctaaattagatatgaaactagttaatgccctacatagcaataaaaccatcactcttggggttccctcctctaccagacagaagcattttcacttcaaccaggcaaaaatcattcacctcccttccatttttctgcaagctagcatctaatgctataaattttgaaccttaatgactataaataggaagctcaaaaaagttaccttcccctagagaagaaaagtgaactctatacgggaaacaattctacctataaaaaggttaaatgagaaagagttaagttggggatttagacatttaagacagatgtgaaaacaagactaaatgatatttagtcacaatgtgtatatgcagcaggggagcacatgcagggcagtgtgacctagtgaagaaaggacaataaagagagattgtaacagtgacgctagagccaacgtgtacataaacaagagaaggcgcaagagagctggtgttttcagacagtgatctgatgaaaagaccaacaacttatattgggcaaatatccaacatgtgccttgataaaatatttattattattattattttttttttaattatactttaagttttagggtacatgtgcacgttgtgcaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgtgatctcattgttcaattcccacctatgagtgagaatatgcggtatttggttttttgttcttgcgatagtttactgagaatgatggtttccaatttcatccatgtccctacaaaggacatgaactcatcattttttatggctgcatagtattccatggtgtatatgtgccacattttcttgatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttcaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcccccgctgtgcagaagctctttagtttaattagatcccatttgtcaattttggctttggttgccattgcttttggagttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcagcattatttctgagggctctgttctgttccattgatctatatctctgttttggtaccagtaccatgctgttttggttactgtagccttgtagtatagcttgaagtcaggtagtgtgatgcctccagctttgttcttttggcttaggattgacttggcgatgcgggctcttttttggttccatatgaactttaaagtagttttttccaattctgtgaagaaagtcattggtaggttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttattagcttaaggagattttgggctgagacgatggggttttctagataaacaatcacgtcatctgcaaacagggacaatttgacttcctctcttcctatttgaataccctttattgctttctcttgcctgattgccctggccagaacattcagtaccatgttgaataggagtggtgagagagggcatccttgtcttgtgctgcttttcaaagggaatacttccagcttttgcccattcagcatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttcatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggaatctttttggttggtaaactattgattattgccacaatttcagctcctgttattggtctattcagagattcaacttcttcctggtttagtcttgggagagtgtatgtgtcgaggaatttatccatttcttctagattttctagtttatttgaatagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagctttggaatgtgtttgctcttgcttttctagttcttttaactgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcgctgtggtctgagagatagtttgttataatttctgttcttttccatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaggtctctttgtaggtcactcaggactttctttatgaatctgggtgctcctgtattgggtgcatatatatttaggatagttagctcctcttgttgaattgatccctttaccattatgtaatggccttctttgtctcttttgatctttgttggcttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtactggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggctgaaaattctttcctttaagaatgttgaatattggcccccactctcttctggcttgtagggtttctgccgagagatccactgttagtctgatgggcttccctttgagggtaactcgacctttctctctggctgcccttaacattttttccttcatttcaactttggtgaatctgacaattatgtgtcttggagttgctcttctcgaggagtatctttgtggcgttctctgtatttcctgaatctgaacgttgttggcctgccttgctagattggggaagttctcctggataatatcctgcagagtgtttcccaacttggttgcattctccccatcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagaataatttgatcgtctgaagccttcctctctcagctcgtcaaaatcattctccatccagctttgttccgttgctggtaaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctcagatggaaatgcagaaatcacccgtcttctgcgttgctcacgctgggagctgtaggccggagctgttcctattcggccatcttggctcctcccccaaatattaactcaaaggtctgttgagagtttaggatggatgcccagattctaccctctggagtttgctgctaagagagctgtttgcacagagaaaatgctaaatgtgaaataaaatggttttctacttccccgtcacatggctcccttaaacctgaaaggcaggtctgcagaacagagccacagtccctggttcacctgctcactagcagaggagcctctggggtgctcagtggccaccagccccttgaaggtagccttgccttggggcactctctatgcagaagtgggaaatgtgagaactctgaagatggaaaatttggtgaggaaacttgagctgaactgatggaaaatgttcatagctttcatttattccacttagtgtgaatatcctatattttaaggcagaactattaatgagtttgataacagggcacttctcctagccccagtggtctatgttaacctttctgaactccaaaagattctggattctaacaccatctgacccaaaaagtcttttatttttatttatttatttattttggatggagtctcattctgccgcccaggctccaggctggagtgcagtggcacgatctctgctcactgcaagctccgcctcccgggttcactccattctcctgcctcagcctcccgaatagctgggactacaggcgcccaccaacatgcccggctaatttttttgtatttttggtagagacagggtttcaccatgttagccaggatgcccaaaaagtcttaagttagaggttgtggtcctgtaccacatgcaaagatgaccaacattcacattttggtatctgatctgatttttcatttccctattgttgggtatttccaaagtggttttcaatttttccatttagaaaaatcctgcaaggatgatttccttatgataaattcctaaaagtaaaaccagagtaaagggatatgtatgttttatggcttttgaaacatgttgccaaattactttctagcattgtttgccaatatttaagaaaggctatctcagcccaactcagtcatactgaatgttactgttacagcgttactttttatttatagaaaaccagcgctctggcatgataaagaattcaagtagtacaaaaatatatacaccctgctgccaactttcatttcctttccccgaagagagggagggagagaggaactcaaccacattccacatattctccttaactctctcttagactttgccagtgcctccactaacactctctgatcttgtgtcttcagaggccaggtgaggagaataactcactgtattccacttccccaaacttggccttctctcagctgtttaatttctggacttgattaaattttacgattctaacggcagttaaaatttccctttctactatccacattcttattcttgcaggatttgacatcctgtagctattagtagtcctttagccctggctgagggaagatcaaaatgtgtaaacaccattagctctctgattactgatgtgacctactagatcttacccaaaccaatagcacaggggcatatttgagaagaccctgttgcaaatagtctcctctggctctaagaaagtctttccctttaaagtcctggccccaggaaagattctctatctcagttctagaccagatctcttggagctggggaacggcagggagataggctctatgtggtaccccgtgagtactgcatgcttggggcaaggatgagcaaatccccagtggaagccatgggtggggtgagggtgctctgaataggccaggacgacagtggtccaccatgacagccactggctctgcccacctgggtcctcacccctggcaaatgcctcctcctgatgctctgaggcttgtctcagacaagaaaggagagcaaacagccctgtgtgtattgattgtaatcccgctaagtagctcaccgctattcattttgaatggcatgtttcccaacacccacgctggggtcacagagacgacactgcccaggacagaacaaaccctcttacagggttccttttaaagctctttcccttttaatcgtagtcaccagtgtactaagtcccattctgtgacaagcaacaggctcaacatcatggagctgtttctgtctgtactaagtctgtaagctggaaactttgtagggagaacccaccaggctgtgcaaatttccctgtgatgtttaaacaaccagctccagaggaggaaggaaaggaggagcgggagagaggtgagacaggcctccctgtcccagctcctgcttccaggcttccttcactagcccccaagctccagagctcccatactgtgctagggtccccacactggtatttgtacccaggcctgtctgcccagaatgctgacttccacaatagctctgctccctctctctccctatcgaagccccaggcctgagactgccccaccctgtccctccggacttcttaggtccaaacctcatcctggcccttatttctatctggtctctaagaccagtaactcccactgcctgagacgcccttttgcatctaccaacgaaggtgttagtatcactgttggcttcactacactactcagacttccaacacatgaaagacaagcatcaaatcacacttccatttcccaacttcccatagactttatgtgtctaagaaaatgctttcaagtattatgtttttcagggttatatttgtcacataactgagattttactgtacaaagtaggatttcatttctaacacaataatttttaagtgttttcatttttattctcaatttgtagccaaattctctttaacaatttcttatgtacttcagcataattgctcttatacttcatgcctataagtgcagactaatttacatcatcaaatgatactgtattttaatgatatccatgcagctatccttagatttatattttacaaaagtctgtactaacaaatgatatagtcacatctctttgcaatactttctagagtttttcctcacaaattattttgtctctctgtgctataattccagtcaaagttgttccatggtctgagaaacacctatactggacaagtatattattagacataccaatatcaacttcctttgggcaaataatttgcaaattgtagctggagggtgttccctgagctgtcccttttaattggaaacaaggaatgaaaaagctgaataagagtgttactaccaggatgtggacccaggtgaagggcctagaactatggactgaaattgccttgaaatgagctgaaattatctgaccagagaaccacgtaagagaccgtcaatacattgttaatgctgcatccagaagcagaggatagattcagcccattgggacattgcaacccagaccttagccatgctgacagagtttcctgagaactgggaataaaagaggacctcctccagcccccagtcctgcaattgtttctccaaggagagtcaaggaggcccagttctcattgctgatctcctctgatgctctgtagaagagtccctctccatgaaaagccaacagagacatctgccccttcctgaaagttctgggtcctccactcctccgtgtaaccaaatgtagaccttccctatccctggctggatctggccccctaggctgtttcatggtgctacttaaaggaagccaacaaacaagctgctttcataaggtcaaagaacacactgggctcatgaggagacccagacaactcctaataaaatcagcatggacccagacctgttcgttttaattcctgatctgctaccaactgtgagaccttaggcaaaaattgcttcacctctctgagactcccatttctccatctgtaaaatgcagataataccaaatagggatatggtgggcataataaatgaatgcacaaaagaaaagtatgaaaacaccaagtacaattagtctggaaatatgttgatgctagccttgaacagtttgtattactttctaaaaataaaaaaggctgctaagaaaattttatgaaaattcatctttctacttgtataattttcataaaaactctggaagtgttagcatgtaaacaatgccagatattcattttctttataaatatctataattgaaatcagctttacaaaacagaacaaacccaagtaaattatatgcacgtgattaattacaaaatttttgtcttattaacaaaaacttatgtaaatctgaattaagaatgtaaagaacattcttgaactttttgatccatttcttcaagcttcattctaaaaatcttaagaaccatagcactacccccactccctgaagcaaatccaactgaagagagagaacagagtagaaccaaacccacgccttggagatgcccatgcttaaaaaacttcacttggaccaatgctcaaagtcactggtcatcaaagaaataaaaattaaatctactagaatggctaaaaataaaaggactgaaaacaccaaatgttggtaaggatgtgaaacaaccagaatgttcatccattgctggtgggagtgtaaaatggtaaaacaattttggaaagatttgtttcttctacagttaaacatggacctacccaatgactcagcacttaaattctaagtttttacccaagagaaatgagaatgtatatccacaaaaagacttgtacaggaatatttatagcagctttatttataacagtcaaactggagacaactcaaatccagggaaaaggataaacaaactgtggtacatttataatatggaatactacttagcaacaaacgggaaaaatctgcttctatgtaatagatgagtctcatagacattatgctgagcaaaagaagccaattatgaaaaagtgcatattatatgagtctatttatatgaagttctacacaagacaaaactatctatagtgaaacaaaaccagaaaagtggttggctctgggggggatagactgagaaagaaactttctggatggtagaaatgttttatgccttaacaggagtgagcatatgttccttagaagttctagtgttctatgccactgtaggatgactctaacaataacatattattagtttcaaagagctagaaggaggatattgaatagtcccaacacaaagaaatgtaaatgtttgagatgatggatacactgataccctgatttggtcactatacattacatgtatcaaaacattcctatgtaccctagaaataaatgaaattattatttgtcaacttaaaaattttttaacataccagattatatatttaagatttgtgtattttactatatataaattttgtactctactagtaggcttgcttttctcagcagtgtgggttagcaattctgaaattaatttctgtgtatcttatgcttgagcaaatgaataaatacattgaggaaaataggagccatgtttcttactgtcagaaaaaagagttacaaatatgtaaaaaggggaaaattagagtgttctctgagtttatggattggaattagaggtaccagtatgaacttatgttttttgatacatagatgaatagataaatatatttcctagctctgtccaccaaaagtgtctgggagcaataacacacctgcagcagtgagtacatctagcacttagatcttggtttctaaataccattctccactaaaacgaacgaagagtccttgaagaaaagtcttggattccaggactggggtgtggaaacacaagatgagtttaggatatcttatttcacaagaacctaagaagatgctcagtgagaaatggggaacattcaataggacccaggattagcttgaaggaacttccatgggccactgaagggactcttctacatctgggacaatttgagcatcaattataataatgtattctatttcactgaataaaataggaatccctgagagcacactgatagaaaaatgccaactaggcggggtgccatggctcacacctgtaatcccagcagtttgggaggctgaggcacacggatcccttgaggtcaggagttcaagaccaccctggccaacatggtgaaaccctgtccccattaaaaatacaaaaaaattagccatgcgtggtggcgcatgtctgtaatcccagctaaccgggtagctgaggcaggagagtcgcttgaatctgggaggcagaggttacagtgagctgagattgcaccactgcactccagcctgggcgacagtgagaatgagactctgtctaaaaaaaaaaaaaaaaacaaaaaaagccaactaataaatatagaagggatgatagaattagaaaatcatcagtggttgccaaaactagtttgataagggtgaaaggttgatgagaaacagaatatttacagtctcaatgcatctcccctcaaattacttattacttacaaaagagaaaatggtaacatggtggagaaatttggcagacactccctgttccatttgctttgtctacataacaaattacccccaaactcagcaccgttaaacagccatttattatgcttgtggattctagagatcaggaatttgtatagagaacatcaaggatggcttgtctctgctccatgatgtcaggggccttagttgaaaaactcaaaggctaaacgctggaatcatctgaagactcctttacccacatgacagcactgggtgttgtgtgtggccgagaaccccagtccttccccaggtggctggtttgggcttcctgacaggatggtggctacctggattcaccactgtgcagttagtatttttcactttgtaattgataaatagcttgtagggagatggtttgagattagatgaatatcctatctcttgatcatgcttttggccactactttcagcattgctgcaaactcttttttaaaaggccaatttatttcatagacatgtacatttttttcaaaaagtccaaactctaaacagtgtaattcttgaaagcacagaatcctttagtttggctcacaagcttgatctttgaaaaagccctctgtttttccaacttgctggtctttgctaatcagataggggtttaaaaaaagatatttcattatacttttaagggtctattattatagactgagctcgagcatcttttcatgtttgaatcatttgtatttcattttctgataactgttcttatcatttgtctatttcatacttacttacagaagtttttaaaatatattaaagaaagtaattatagaatagagaaatatattcaggaaaatagccctttatcagttacacaagttgcaagcatccttgtcaattttgtgtttgccttttatcttttcattttgatttagtgttacttttaacacaaaattttttgttgtttctgttttgtcgaatttactaatttgtgtgtgggcgtggtttcttagaagagccttccccattctgatattattagttaaatctcccatttttatatactacttgtatgatttccttttcatgtttatatatttaatctacctaaaatttattttggtgtaagacctgagatccagcttttttttaataagatgatccacttgtctcaatatcattaaatgaatagtccgcattttccctaagggtgtagtttatatcatatactaaattcccatatgtatttggtttgactttctagtctgtattattgatttaatcatgcatttgtaccacattgttctaattactatagatttataatatgtttcaatatctggtaggatgtttccctcctcgttactcttttttttctcacaatttttctgtccaagaatatgcttgcttgtttgtccatgtgaactttagattcagttgacatgcctaaaaacttctggactaatttaaggagacttgacatcttcatgatattgaatcttcccaagtatgaacgttcaaacagtagacctttccattgcttaaggcttcttttgtgtctcctttctttgcgtagcttaaaagagcattttaatatgtttttcacaagagctgaccactgtgtcttcttgccctgtcctgtaagagccagcccccatttgttgccatttctggacattttttttttacaataaagcaacatggatgtggagttttaggatgagtatactaaagtttcattaaaatatagtaatgtgggctagacacagtggctcacgcctgtaatcccagcactttgggaggctgagccaggcggattacctgaggtcagcagttcgcaaccagcctggccaacgtggtgaaactccatctatactaaaaatacaaaaaatcagccaggcatggtatcaggtgcctgtaattccagctacatgggaggctgaggcaggagaatcgctttaactcagcaggcggagattgcagtgagccgagattgtgccattgcactccaacctaagcaacaagagcaaaacttcgtctcaaaaaaaaaaaaaagtagcaatgtgctattgcacctacactttcaaatttcaagtagaaaacaatacttctggtgatgctgagaaactcaataccattcctcagagagccgtggccatcagcagacaaatttatttggggggtattttatctgtttcatcgctattacaaatggattcttttctccaatcttgtcttctgcctgattgctatttatatatagttaaatgggtttataggttctctaagcatattacttaatgggaggaagagaatttaatttctttcttataacaatcaccaaccataatggtagaaaatgaatctcaggctacataccaaaaagaacttcaggcagttcttttttcttttcttgatagaatgaaatattaatagaacattcagcaaattggcttttagactgtacatataactattcaataagtaaatcttagaaaaaataaaaacagcttccacttgtattaactgtatcagccccagttaatactagtgatgagatagagagatagaggggtgagatatggaagaagattttgcagtacttgtcaaaagttataaccatacatccacttggggtgtggcctttgcaatcgttgcactgccttaaaaaaactctttttttggccaggcacagtgcctcacacctgtaatctcagcactttggacggccatgctgtgtggcagaccccagcagcccacggcagtgaaaagtgctcttcatgctaaggtagtgcccagcacaagccatgtagactccagcctcagccagctctggactctaggctgaccatcaccaccccggtttaacgggacaattaatagcctgctttccaccagagacagaagtggaaaatcaactacggagttttaacattctttaattatggacacgaccagcttcaggaaaccactgatttcataatggcctcctcccagtgaagcagctgttgggcacataatcctgggcacaaggcactcagggcaccgcgttggcttcttcacagaatggccactgggggtgcttcctgactccataggaggggctagagcatgcccctccacactcagtaagcaaagatggatcctcctcaaatgtcgcatttgccacaagaaccctccaaagctagcatgcttttaaaaattaatcaactttttcttcaagagcggcccctttttaaaagagatctattgatgtacaacatttgtaaagtgatttgcaattttcggtctcccttgccctctccttatccagtcttaaaataacttcaagagggaggtgttatgctaatccttagtttacaggtgagaaagctgagatcaaggaggttcaaaggcttgcctgaggttccacagctgggagacagaaacgtctataattggctgtggcccctgggggtggccaactacagggtggctgctgctatctgggtagcacaggggaaaataacaaagtaaaattgtctgcttctgttcacacagcttaaaaaaacctctgtccatcttccaatggttgataaagcaacctgcagagcaaggctttgcttctgttttgtgtggaaatctaggtaggaggaaagagacaaacggtgtagtgtcccaaacctcaggaaaaggcagaaataaactccatgaaaccacaggagagaagctgagacagattgacagaactccgaaagagaaactgccagaacccaatgagtcatgagctcttaaacggaaaatcaggctgcatagtgcctgcttagataaaagagataattagatcttttgtttgtatatttatcctaaatggcttctccactctttgacgatatctttgctaagatttccactgttttatataatgaagttttatgggattttttttttttcaaagaggaatctatttttatagagctggaatattgtgaggctaattttgtatctcaaaaaagcaggctctctgcaggggaggcaagtgagtctctgtcgccacctagtggacattgctaaatgggagccagcggagaaggctccccataggcacttggagcccccagtcacattgcaccaaggacagacatgtgacagccactgaggggccaaagcagtcttagcaggccaacccacaattgcgtgtcatttctgattagaagcacatctcatttaaaagatcttcaaacattgcttttagcatttgtacctagagtgaagcatcacagattaagaccaggtgtggtctcagctggtccatgtgtcctgatccctgtctgttctccaacattattttcatatattccccttaaccacagtcctgctttgttgacttcaacattcaatccagtatatggaccatttgagctgaccatattctaggtcccaacctgaaactggttctttcttctggctttccaaccctgccttcacctatgacatgccaccatgctacttctccagctactaaggcctgtcatctaggcctgtctagaaagccaaaaaaatatttttcaccccttttcctcctggggccacgccctgacctttatggcctgaattctggattcgttcatttattcgacacgttttgactggacaccgactgctgttatttgcagctgcagcattgtagagagaagaggccagtatggccagtggaatcaggagaggacatctttacagatggctttaaataggcagcccaggtggagaagaagaaatagtttcgttgctgggcttgagcagcatgatctctttccagttcaatccaccatgcctcctcaacctgacttctctcctttattccttgactcaaaatccttcaaagttccctcctgcatccatgcagctcatccaaggagtctgcattatcctgtgctcagagatacaaacaggggtgggattcagttcctgaccttaaattgctcagcatgaggaagacagaccagcagacccagggtgtggagacagctgcctaaggctgggctaatgagtgtctggggagccagagagggtgagaccaattctgctgggcagcagggagaggctggccaggggaggttcccaagagaaggtgacattcatactggatgctgaaagatggatagaagtttatcagcaagaggagggggaaggaaatgtgaagcagagagcattctgggcagagggaatggcaagtgaaaaagcacagagttatggaagagttaggggtcagggacattggtccttctgcacacccaggaaaggaggtgcacagctagggcaataatgacccagattccaaccacaacactggatgtgatggccatatgttcatccccaccatgtgggtttaacattcctgaggttccctgaggcaacaagaactaataatgaggtttcaaatgaatacaatcccatgcagtcactttgagtctcatttcccctgccgctgcactgatctggctggggttgtctgggcccagccattgtcatcatctccgactctggaagcaaggctcatatctacaagtcactgtgtggaccgaacagtgtgagttgtgggactgaggcattgatttcccagctgtggcattggcagatgatggcttagatgagttttcatcttgctcactttcaacttgctctcagttacagagagctgcctcaccgaaagatatgtccccttccaatagataaccccttcccatagacaatccacatctaatagatgggtagatgcagggggcaaggcctggacccctggttttcgtacagcaaaactctgagggaccatcctagatccagacccccagtgggattggctgaaacctttgtcacatttgcatcacggcccaactctgtcttcccaatgttgatcccaagggcacactccagtcaaacttccacacacaaatctgtctcagagtctgcttttcagggaatgattcacaacagatagcttaagaagcctggttcccattcaaacaagatcctacaggatggacatagacccagagacctcactcagaggaaactgaaaaacaattctgcttcccccagtttagccctcgctcagttaaaatctactaggaaatagatttcttttcccctagaggtttgggaaatttgtttgggaaattaaaattgctttttcacaagcaagacaactaagggaattgagagctcccccgggggtgagccgagatgaaggccctcctgtgaggagatattgccaatatacttaagagcaagaatttctataaatagcccctcggaataaaggagatggtattgccagtaactgctctatgacttcacttgaaagcctcaacagcaaagtgatacatattatagacaaaagagccagtcaaactcgtgtccgcccagccggctcagtgccatgggagggcatccactcagctgccagtccccgagggcaggggccaggagcccagctggttcctttgggctccactgtaaatgtggaattctagatagacttttagtgtctctcacagtctaggtgtttctctgggtggggagtgctcctcaagtctctgcttttgcaaattgacttcaaatggaatttagaaacttgctcccatccctacaccacttttatctcctccctaatccatcttctcagcccccacaccatatccctgcccccctctgaagggtgggtcctcagaggtctatcagggagaacacatgtgccctctggtccacttgatcagctgagacatcttacccagggcttacctgtcagctgagatgaacctggcaatgtcacttcagaggcaccagcaaggtgtgtctgagagcgagtgctgggggagacctccagccatctcaccaagcacctcttttactccatgggaaaaggaggtccagggaagtgaggtgatcagagcccagactggattcctaggccagtgcccttggcaccagacactctgtcgagctgctttcatcgcatattatttgatcacatatttagtcaatcaccttagtgaataaatgttaagcccctagcatggacaagcacagaggtaggttcactacaaagaattgggaaagtcttggtggtgcatggtgtgacgccagaggcaggcacacctaggaggatatggtggcacactctggagaagcacccagtgtctgcaggaggccttagctccaagaaatgatgggtgaagactcagaaaggccagacgaagggccagggacaagtgtctctaccttacaacttggccaggggcaggcctgacattcactcagcctccagtgtctaagagcagagagtgggcactgcttcccaggaccggctacataatttgcagggtctggtgcaaaattaaaatgtgaggccctttgctaaaaaaatattatgcatttcaaagtggtgcagcaaagcattagaccaagcacgggactcttc

SEQ ID NO: 11758 - DNA, 32798 bp, Human
cctttatgagctgtaacacagcgaaggtttgcagcttcactcctgaagccagtgagaccacaaacccaccaggaggaatgaacaactccagacgcgctgccttaagagctgtaacgctcaccgcaaaggtctgcagcttcactcctgatctagcgagaccacgaacccaccagaaggaagaaagtccgaacacatccaaacgtcagaaggaacaaactccggacacgccgcctttaagaactgtaacactcactgcgagggtccgcagcttcattcttgaagtcagtgagaccaagaacccaccaattctggacacaatatgaatatggaaagttgctcatgagatagttttaagtgaaaaaaatcaagttagcaaaataagtgtggtccaatttctggttatattccttagctggaatataaacactgctagtgtgggctgtccattgttgacatcgctccctccacctcccgtgtgttcgcattaatttatatgcgttgtggcttttgttctagctgagaggagaagaggtatagttggtacaagagatgaggaggaatgtggagaaatatggtgagtgcagtaaggaatctatttcctgcctcacttctcatactgggttgagcccctaggctttgtgaatgacagctggaaaggatggaagtgtttcattttttaaaaataaaaatatgatattgtaattttggacaaaggagtagggaacaaagcccaagaaagttcaggaaagaattgtgagattttgtgcatatggagcagtaactcctagaccagatgtcaaagactgccatgaagctggagaggagacaattctccccatctgtgtggtggaggctgctcaatgtcccccaatttcgcttcatctcatcttgcttattaatacaatttcagttaggcactcagctgacaggactatgtttcacagatccccttgcagctaggtgtggctttgtaatcagatggaatgaggggatatgattgtagaaactggagcagccatcttgaatgaaagatgcaaggcaagctctgatgatggcagagtcacgagataaaaggagcctgggaccctgtcacaggacagagctgccagcaataccgtctctataacaaacactaaatttaattattcatatctaaatctgaacataggcagtaatttctaaccagtgtttagcccagcacaaggcctgggtggtagacttccaataaatgtagaattaagtttattcacactatatagacttattgcaaggcaagaatgagaccttagactttcgtgctcaatcttgaagacaatgtttttcaacccttttcaacagattctctctcaaaacctaaaatctcatccaccatcccactctctttttaccagggagatgtgtttctcaactaaagaaatagaagaaagtgtgttctctacgtattgtcagttagctaattagagcagaatgctggtgatgccaaaatctgtagccccatcccttatatggcatttgagaggagcgagtataaagcagtagataataccaaaggttttggcctcagggccgcagttatctctcctttgtgagaccttgggggcactgtttaacctctctgggtctcatccaagaaatggaaatactaataatactccatatggttgttgcaaggatgaaatgagatgtctgtaggaagtgccgaggaatgcctagcacaaccaagagcttgttgaacttgtcacgctttactgtcgataatgtgcattaagcaaacgctagttttatttgtttatttcatcttctaagtataagaatacattgtagctcgacattttggcaccagcccctaaagcattcccaccaccacccccgctgcgacaaagccctgcgctccttacgacagcgtacgacgccgagcctgacaggaacgcctcgtgcggtagaaccgcgcgggccaatcgcgctgctcccgggtgatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaaggtgagggccgagtaggtgaggtcgtgttgagccagaggcacggaaggtcccgctcagtgggtccggtacgcggcttaaccgtgttgggctggcggaggccgggcgcctgggccgcaccacccctggccccgcctctgcactggctcagcccggccctgggctccgaggtggccgctcatcctgcagcaggcgagggacggggctgggcccaggctgtggcgagtcctttcgggttgtgtgacggccggcggtcacacatgccacacccccaagcctgggccgagggccatcccggtcacacataggcctctaccttggaggaagtgtaagccacccatgtcccgtatagtctggctttttataccatttgcctttttctcatcctaattctgatccctgagtggcctaagtttatgcagtgggcaggtaaccctggggtcacttcttgaatggtttagatccagtcagctccaacagatagccctcggaattcccctaaggtcttgtcagtgttggcagctttcaactggtgttcattgccatctctcacgacttcctggaggcttaaatctttaattgcagcaggttatcagaacaactctcctttttaatctgcttaccagatacagccaaattgtgtgtatgtggcaccgtggctgggtactatgttagtggagaccttaaaaataatatagcgatcaaacccttttgtttcagagatgaggaacctgagttctcaaaagttaatgtaacattctgcaagtcatgcttttagggagcggcggaggtgggactgaaactcaggattgtcaatctgctgctttttgggtttgctgtcctgacctcaaatgttaagagttgccttggaataggaaacatcagtgtaggttttgtcactgccgcccattttcctgctgtgagcaggggttatttgcttgcttgctttctgcctcattgcccttaggaaatggtagccgtccacatatagagattagggagattatgatgcaatttgtcaaactgtagtagcaccagaacgtaagtacattacttggtgcattttcctaagttaccttgtctaatttgctattcctagttgatgtctcaggaacatcttcatagattgttctaagtaaatacggactgtatatacacgctagcttagagttaggaaacaaaaattacaggtaaaaagattatcatgtatagattattcaagtatttaagttagaactttcagagctttatttatttatttatttatttatttattttgagacggagtctcactctgacatccaggctagagtgcaatggcactatctcagctgactgcaacttccgcctcccgggttcaagtgattctcctgccttggcctcccgagtagctgggattacaggcacccaccactacacccggctaattttcttgtatttttagtagagtcggggcttcactatgttggccaggctggtctcgaactcctgacctcaggtgatccgcccacctcagcctcccaaagtgttggcattacaggcgtgagccaccacggccggctcagagctttatgacattaaaatgatccctggcactaataattagccatgttttctgaaaattgaataaaaataccattgaatacgtttttaaaattaagttaaatatgagatgatttgttgactattgataataaaaagatgggtgtggcaagctgaggctgaaaaatttaaatgattagttattgtcaaagaggggatattgatctgtagcttctgtgtggcaatggaagaagatacactaataatcctcgcttgatacgtttgcccaaaattgttctgttatcatcaaccttcagtagttctatgttttgaattcatatcttacataatagggacattttctttttctagagaggccatttcaatcgaatatctcatggcctacagggactttctgcagtgcctctgagaacttacgcagatcagccgagtaagtacttaagtaaaacatttttttcatcacattagctgacagttcctttctatttcaatgtaaaagcaagtgaatattggaataacttatgttaagtgtcttatagttcatttgttcatgtatttattcgtttgaatgtatattgagctagtgtgttccaggcggtgaacaaggtaaaaaaaccctgctcttatgaaacttgtaatttggtgataaaagacaaacaatatataagtaatggataaatattttgggaagtaactgaaaattaaagcaggtaatagggaggaagagagataattttagatacagtgtcaggaaaggcctttctgaggagatgatgtctgggcagggtcctgagtgaagtgggggagtgaggttacttcaggcagagggaaacaacactgagaaaggcctgaggtgggacttagcttgtgaagtttaaggagtaataagaaggctggtatgactggagcagaaacccatgcaatgtaaagtcggagaggtaggcaggagacagatcatggagtgccttgtaaggcaggtctagtagtttggattatactccaagtatgatgggaaacaaaggttttgagcagggcagcaatttcatatgtttacatttaaaaagttaattttgtccgttgagtaaggttgtattggttattttaacactgtttagaatgatgagatgactttcttgacatcctgaatgaaagtcttcatgggtttatcaaaagcatgttttaaagattagcaggatctaaaaggaagctatgggtcatggaattttctcctgtgtactttttttatatttttgaagttcccataaaggatatgcattttatttttttaagtatttaaaacagaaagttaataggattatattgaagtattttgacctgtcagtaccaaggatattgattatttgcaatgtactgttttgacatttactgaattcacccatatggattataagtaacattggatgtcttaaagcttcagttatagaaatcattatctgggcaaactgtgactatcagtctccctgcattctgtgaagtaatttaatcctgtatcctcaactgttatccaaccattatcattttggatattttatttctagaggaagggtagggggaggattctagtaacccatgactaacagtgagtgagtgatttattctagctttgaacaggtcaagaaatccttttaaaaaaatgctaatatgatgatgaagggaaaagttggacctcttatacactttgtctcttgttaaataggaatctcattcttctcaactcatataacaggagaaatgttagattttcatttctaaaggatatttttcatggctaactctatacctttggcatcactcagcagagattattcagtgccttctatttgccaggcagaccctgagccagaacttagattttagtggaatgaggctgagtgttccataatcagtttggtgatcccttgacattgagtaaatcataaatcacttagtacccatgtgtgtaaagtgtgtaaaagctttgagtggatgcagtaacaagcattttacacacatacttgtattttatctgaggtacatgcttactgtcttttcctcaggaatgcaaacttcatcaggacagggactgtgtgtgactgttttgtttagtatctaaagtgatacagtaggtaatcagtacatatttattgaatgaatgaacactggggcctggtctgttttaattactgctctgtggcaaagcatccagtatggtgtcttgtacaaagtaagtaaccagctacaacagcaataatattaactgatgcattgagggcttcactctgtctcaggcacagatttaatcctcatggcctttctactacctgtgtgctgctgttctccccattttatagatggaagagttaggttttttaactaggaaatgacagagctgggagaatccttttgacttcagagcctacactgttaatgttttattgagttttcttccttacatgagtattgattgactctcctgaggagttcaaatcttattatgatatagtcttggttacaacatctgagagatgtctgaatagccttatgaaccaggttcatcagaatttgcaaagttgtgtgtgttactgttgatgtgacgttttatttcatgacagcacttaatcaaacttgtaacacttaaacttacagcacttatatcactcacattcactacattcattcattcttttattatttcgacaaatactaatatctactatgtgttagtcattgggctaactactggagtaccgcagtgagcaagacggacaagacccagcttttatagagcttacaattcagttgagggagacaaacatccaacatataattgtgacaggggtccatagacttaagcatagggagtaatgacatctatatatggattgggaatggtcacataattctttcctaaggaattatgttgatagctaaaaaggttgagagtaactctcgttacaggttggaccttttactgtaattcttttttttatttagactgtaagaaatagggctatgtcatttatatatacacacacacagacacagcatgtgcagacacacccctccaagagcctaaagtagtgtttgtaatgtgaaatgcctgctgttagtgtttatttctaggtagatggaacagatcgtacataggtagaccagcataattctatgcatgtaggctaagagtagtaattcaccgttactgaagcttaaactgcatggtattggtgagtaaacagaacgtggtaggagatgaggctggagaaatagttactgaaggaatttggatgctgtacttaggaacatgggctttatctaacaagacactggagaaccaacagagcgtaacaacagagagaataacatctgagttgggttttagctttgcggtagcactgggtaggctaaaatggaggatgtgaatgaggctagaggctgctggactgaagtttggaggtggatctgagaaggggagtgacactgagttgctagtatgcacctagcacctccttaggatcttaacatgcgtactctctgatcctcacaaccctaggctgcaggtgtcatccttactattacccccatgttgtatcaaagcccagagagattgagtaatttgcccaagaacttaacggggttagagtttggaacccaggtctgttttacttcagatcatttcttattttactatatttcttctttagggaccaggaggttatgactagaaagtagagtattgatttcagaggctgaacagttttgggtgataacaagtatagagtgttaactatgggaggaggttactgaaaaagactggatattaaggccattgacaatgtaaaaacaacttcccttacccctcaacaaaatgtcaacaaataaaccttatcaagtagttcttacattcagtaaatttggtaattaatgattattgccttatgacatctcttttcctgttcgttttttctttttaaaaatctggttttgtttttgtttgtttttttttttgagacaaagtctcgctcttgtcccctaggcaggagtgcagtggcgtgatcttggctcactgcaactccacctcccgggttcaagtgattctcctgcctcagcctcccgagtagctgggattacaggtgcctgccaccagcccggctaatttttgtatttttagtagagatggggtttcaccatgttggccatgctggtctcgaactcctgacctcaggggatccacccacctcggcctcccaaagtgttggaattacaggcatgagccaccgcgcctggccaaaaatctgattttacctttattttgacatgtgcctcttttttctcactgtgttttaaggttattgaaggtactgatgagtcataaatatttgatttcattctgtaaagcatattcttgtcattttagttgaagttcttgattgtcctggagattatgggatcatctgagtgttttggaaggcaatagaacataatggtatataggagcacacatttcagaatctagaggaccttgtttgaatcctggctagattacttactagttgtgtagccttatgcaaattatttagttgttttcaaccttttcttcctctgttaatggtagtattaaactatgtcatagaaatgtaatgaggcttacataagacagtacacgtgactggctcactaactggcacattttaagctacccaagtggtaggtattattgtagactgactttttttttttttttttttttgaaacttggtctcactctatcatgcaagctggggtgcaatggtgcgatcttggttcactgcaacttccacctcccgggttcaggagattctcatgcctcagcctcctgagtagctgggactacaggcacgcaccactatgcccagctaatttttgtatttttagtagagatagggtttcaccatgttggcctggctggtcttgaactcctgacctcaagtgatccacccgcattggcctcccaaagtgctgggattacacagactgacttcttgagatacatcttgtaattatattgatgattacaattgatttgtaacacaatacctttatttcagtggtagcctggataaccaggtgccttattttccttataatgatctaatatgtaacacttgtaggaatttgtagagtacttttcttgacttttttctttgagttaattttaataacattaattgcgttgtttaagtcagtcacctcttattgtactccagtatttttaaagtatcaacctgatactttaaacctggtaggagcacacatttcagaatctaaaggaccttgtttgaatcacttcactgaaacacagattgctattcacctgtcatttgccacttttccatcaggtttgccttaaataaatgtatttcatttaactacttttctgtatccttttttttttttttttttttttgagacagagtttagctcttgttgcccaggctggagtagttcagtgacacgatttcagttcactgcgacgtccccctcctgggttcaagcgattctcctgcctcagcctcccgagtagctggggttacaggtgcttgccaccacgcctggcaatattttgtatttttagtagagacagggtttcaccatgttagtcaggctggtctcaaactcctgacctcaggtgatccacctgcctcggcctcccaaagtgctggaattacaggtgggagccaccacacctggcctgtatcctgattttttaactttttttttgagacagagtcttgcactgtcgcccaggctggagtgcagtggcgtgatctcggctcactgcaagctctgcctcctgggttcacgccattctcctgcctcagcctccccagcagctgggactacaggtgcctgccaccacgcccggctaattttttttgtatttttagtagagacggggtttggtcttgatctcctgacctcgtgatccgcctgcctcggcctcccaaagtgctgaggattacaggtgtgagccaccacacccggccctgattttttaactttatgtatgggactcaacctgtgaaattattcttgacaaggagagggtgagtcagaatcatgtgttatcagctttcatttatatgcatcctttggtacaggtgagaggtagatgatttgtttttctgacattttattatgaaaaattataagcatttagaaaattataagaattttacattgaacacccatagttttcttccattaacattttctgtgcttacagtaccacatatgtgctcattcgtttatccatcagtgcagacgtgtgtatacttcccctaaatactggtttgtttttgaaagtttgttcctggcttataccctcctgtattctcagttgacagatctttacataaagagtctgcttttttctcatttttgtgcatcttagcactttagtggtattgtaatggaatattacatctagtatgtacagtgagagaggagctcttgaatttttggtattttctgaagtttaaaaaaaaacacctaagattacatagtgaatagggaagtaaaacccaaggtttttggctattatcttttatctcttgtttacttctcctgaccttactaaaacaagttcttttccaaaccaaatttatttatcattttagtaccatggacctactataagaattgttacatatcagtgattaaaagtatatgctcaaaaatacatatacttaaaatctaaaatatttaattcagttttattgtcattaaaagggtttttggagaattatagcagtaatatatgttataaatatatatgctcatgtaagagtgagaaaagaatataaaatatggcaaaaattgaattttataaaaactttcctagaagaaggattgggaggacctataaacagttctctctgggctgtatggcaatgtggatgggttgttttttttttaattttgctttagtgtatttaaatttattcagtaaacctaaatttttaatcagaaaagacattaaaaattcagcaaagaaacctgttttgtagcttgtatttacattactctgaaattaaaaattagaacccatttaagggatgttgtgtagatcgtcatttggttcaagatttgaaaataaaaatacattttattagatacttaattctgaaccgaaatcagtgaaccaagcagggtggctaaaaagcacagatggatcagtaaaaattgaagcaatttttcatgtattgaaatgactatacatattttttcatgtattatctcaattatcatctgctataaccaaagagaatctagtattttcatttattcaacaggagggattcttagattttgtggataattgggctgagtaacttagttatccaccaacacagaggttctgtgattctgttcaggccagcaaaggttttttgaatgatcctactctagggatgtgtgtttttggggagagggggtgatgcaaattaaaatagtcttctttgtaggtcagaatatagctactatgtatagaatacttattatgtatgctataggtactatgctaaattatttacatacattattttattctgttatcaccctatgaagtaggttttttttgtggtctttcttttgccaggtatggaaacaaagatgaagcaggttaaattactcacctaaggtcacataggtagtgattataaagcttgattattgctctctggaattttagtttatgatggttaaaactgaggaatggaatagtattgaataatggaaagaccaccggaagtagagtcaaaaagcttagtttgtctctgcaactcacttgctggttaaccttagacaagttaattgacctctctgaacttcttgtttattctgtgaaatgtcttatttatgacatctttatcttcctcataggaaattctgagactcaaacatgataatatatgtgaatatgtgttatgaattgctaaatgctagactagttggggttgtcaggacagtggaaggggaagaaaagggagactgtttcctaactcttaacagtcactgttactttatttgaagttggattgagaagaatgggagtaattggacttacttgcacatttgtattacaattgttaaactcctaaggatactgatcaaaattaattttcaattttttatctttatttgaaaaatggccacaatagttaattgaatattctggttagcctattatcttaaggtatgtaaaaattatcaatatgcaagttcaaaacatatttgttaaatattacatagaagctgttttttccctcatatttcagaagttaaggacctgaaaaaggtaataggtcttaaatttattggaaatactaaagcattatataaaattatcttatttaattctaacatcaatcattgaaggcagtgttttcatccccatattacagaaaggttaagtcattgggtcaagttcatacaactactcattggccgtgctgagatatgaagcccagaatgtcagattccaaagctcaggctctttgcttcatacatacttgtcttccagtatcactaaattccgtcagttattaaatcaatagaatttaggaaggtcagtgaatacaatgtgagtgttacagaactcagttgtgtttctgtatgttgtaatgaatagaaaataatagaaaatgaaatttgagtatttatgccatttttcagtagcatcaaagagcatcaagtagtagtaataaaatagtgcagaaactatgtagaaaatgctgatttgtactgtaagaggtttaagtatcgggttatttgtttgctcttccaaagagctctttttggtaaatattaagcaatttactattttatatcaatttgcttttatcgtagttgatgctgatgtaacagttataggttctggtcctggaggatatgttgctgctattaaagctgcccagttaggcttcaaggtaaggtttgaactcaaactaagtattgatttattttaatttgggaagggttgatcatatttataaagtactttgcaggcaaaaacatggtaaatacttccttaactctataaattacttgtaagcctgagactaataaagattaggttcatttggttgtagtattctcttggaatggaaagtgaaatctattagttttcttctcttcccagtacttttcattttggcatctaatcacactttggaagatacagtgatagaactaaaagcatatatttggtaatgttaagcacacaaaaatatcttttagaataattcacttttgggtcagcccaaaagtgtttattattattcaaatgataaattataaaggactatatattttagtctgtgaaaacatagcccgaatagcttgttttgtagaagaattaagacatatatttggaattttagtgatctgaaacattgaggttatgtgcagttaaataatgttttctttggttgtagacagtctgcattgagaaaaatgaaacacttggtggaacatgcttgaatgttggttgtattccttctaaggtgagcatgtgttttgtacagcacagagattgtttttggctagcaaccaactagaaggatggattgagactagattagacaaatacacttgttaaaaaacaatccaagttgtggcacatttcacacagagaaaaaaaagaatgataaaaaacacacttctcttttgtaaaacttaaagagtgctgtcactagtctgccacacattcctgaaataacttccttgtctcagaatgcctagctttccattcaaacagactctgatgttctagttttttctctttatctttccttcaccagtgtaacagataatagatagtaaattgttcttttaggtcctttttgtatgtaaacatgactgcctttttcacctgccaccctgaagtgtgtacttatgcctttacttttaaagaaagtaaaaatgtctttttcattcttgtttgttgaatgtttttcacatcattattgtttgtctttgattaataagagaaactgaattggtgtagtgccatatactattccatgtagagaatgccatgtcttttttttaacttctttttaaatttttattgtaaattgacaaattacaattgtatatatttatggcatacaaagtggtgttatgatttatgactataatgtggaataatttagtcaagttaattaacatattcattaccacagtacttatcatttttgtgatgagaacatttgaaagagaatatcggccgggcgcggtggctcacgtctgtaatcccagcactttgggaggccgaggcgggtggatcacctgaggctgggagtttgggaccagcctgaccaacatggagaaaccccatctctactaaaaatacaaaattagccaggcgtggtgatgcatgcctgtaatcccagggacaattgcttgagcccgggaggcggaggttgcggtgagctgagatggcgccattgcactccagcttgggcaataagaacgaaactccgtctcaaaaaatgaaaagaaagactatcatttcataagtgctttttgattatttgaagtctgtttatgaatatttgataatttgatctttttaatttcctttaggctttattgaacaactctcattattaccatatggcccatggaaaagattttgcatctagaggaattgaaagtaagtatacttttcatgcttaatgatattaccagactgcttgacttggctcttctgtctaaagacttaaatgtgtctaacgtacgcataatagatgtttagtgaaggaagagtaaaataaataatctaaaaaatgtggagagatttacttaaaaaagaaggcctaaatccagatttctcccagccaagtataaccaagcctaaccctgcaaatccagatttctaccattatatcttctgttcctttgccaactttttcctgaggtttgcctttatgtgtttttgaagagtcagttttcatttcctaaaatctggaaatcactgagaaggctggattcctgagtactatggggagatagaggaaggaaggaaggcccacttaagctgttgatagtagaaaaattagaggagagaaagagtgaggcatagcggaaaaggaagaggacatttcataacgtatcttgtctcctgacatactttttgagctgttttaatcttttgtctccaattattgttgttgttagatacttccagaaaggtagtctcttctgggcaggacctagtcataaccttgggttgttacttttccttcatttgtttctttacagaggtaggtttgaggggctacttaaggcaatccattgggtatagagatgatgtatatgcactaaagcaaatagaatatcatactagttgaaaaatggaatgacgtaaagaaagaagagctaggggtagtcaggagacctgcattgtaggcaaggcttttacatcctagctctgtgaccttgggtaaatcagaaatctctcagagtctctttttccttatctctaatatatgtgttggttatatgaggtactttctaagatacccttcttacctctaaagtttaattgagttgagcatttttatctaatactgttgcttcagagttctcttctgagttgaatgagtgattaaaacctaggtgattaaactttttaatgttaagcttctgtatttgaaatttttaaacgtgtattttttatttgttttgtttcatgaaatctagcattttcctttatttaaaatttcagatgatgttttactttgtcatttctacttacatatcttccagacttataaccatcgtaaagtgttcagaggatatgttatcacagtgggatataatgttttattttggactgcctttttacccaaggtagacattttatagtgtttgataggttctgtttctgtgatacaatgatgttggccttttgtcaactataattataagttattacattttgaaactttaatactgccttttataagcattaggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagtaaaagctttaacaggtggaattgcccacttattcaaacagaataaggtcagtgtttaatattcagatttctgctttactttgaatacaaattaaactttgcattatagagtgatgatatttgaacttggttacaggggaatatttatttaatttaaaatagcttgctaacctgaaatagatttccctgacatatatcacagatttttttgctgcaccatggtgtagcattactaagtaaggaagcattttgttttagataaattatttacagagtaatttttcctttgaatgatttatcaaacaaattactttaaactttgtgaatttataaagattattttgtaaaggttgttcatgtcaatggatatggaaagataactggcaaaaatcaagtcactgctacgaaagctgatggcggcactcaggttattgatacaaagaacattcttatagccacgggttcagaagttactccttttcctggaatcacggtatttatgcttcataatttacaaccattacaacttttctttagaaatacgttttataagttatttatgctatttgtgaactttgagagatttctgactgaaatactatattttgatggtcattcagctttgggaagttacctgtctttattctgcagtgattctgaccagctatagaacactttatattaagatatgtttgaatacagtatgaagttaaaattgaccattgcgtttggaatattggtggataaaatttaaagtcagtgtttttaatgggatttgatgaaattaggtatatagatacctcaaaacaaataaatgacttagtatttttagtgattctactgagatcacagtttataaatacatttatctcttcatatccttggaggattggttccaggaccccccttggataccaaaacccacagatgctcaagtgccttacataaaatgacatagtatttgcatataatctgcatacttcctcctgtatactttaagtcatctctggattacttataatacctaatacactgtaaatgctatgcaagtagttcctatgctgtattgtttagggaataatgacaaaaaaaccatgtgtacatgttcagtacagatgcaaccatcaatttttttcctgaatattttcaattaatggttggttaaatctgcaaatttggaacccatggatatggagggtcgactgtactaggttttttcaaattattttgattatatcttttgtttttcttacagatagatgaagatacaatagtgtcatctacaggtgctttatctttaaaaaaagttccagaaaagatggttgttattggtgcaggagtaataggtgtagaattggtaagtgttgtctttctgcctcttattacctccttggagttggaagggacttaaaggtcccctttttgattttttgtataacattacaggctgatcagcattgagttttgcttaaacacttctagtaataaagagtttacttttgtttttttcaagacaacctatttatgtatttactcatttagaatgttctcctttattttagtctgtttccttgtaccttccacccttccatttcctagaactggtcgaattcttttttaatatgacagccattcagatatttgaggacagcttttatcctgggcaaattgcattccaaataaagattattctctttaccatcacatacatgatttggctcttcccttctctatcctcatcttgatgcctcttaacttaggttttagaaatgtcaaactacttgcatttctttgaacaccatgttattttagaccttctgtctgccttgttctcccttcttgtccatctggcagctttccacacatttccaatgacctccctccattttagagtcactgtgccttgtaaacaccaggaattgctctacttctgaaataataaattcagatattttattatgtaaccatgacctcctttcctcttttactcagttattcatagtgtactttgtacccttttttaggttttctagtccatagatctacttttttgcaatcttccctttccaatcttgactgcgttcctgatcagcttagatgccatagtccatcactttaaccacactcttacagatgtccttgagttgcttgtctcactgttctgtcatatctgcttggcaaaactctagttcggtttgaatgcagcagtctgccttttttatgctatttccaggctgttgactacacctggagaaaaacacaccctactcattggtacttgtattaattcttggcacaaaccttaacaagaacctcagccttgctgacagtttattatttcctaagatggtacactgccctggtctctgcaatggccattttcattttctactcttctcaaatctctgcttgtatactgtctgctctgcctgtggatgaccttgtcttttaaatattacataaaagagaaatcagatgagaactccctcaagttgatgtcctaaatttgataatgcttttacctgttgttacacctatccttttgattacctctcctattactgtggaaatgccattttccctaagactaatccctttacttgtgcttggtagcacatcatctgccttttcagagacttggttttgtgatttttattcttgtatttttcagtcttcaaactccttccttttatttacaatttcatgtgcttctatgtgtgtacctgtgatgcatttgcactcattaacacaggtttgtgtgcacataaatgctccttatcttggtcccatgtccttcttgagttaccaattttgttcgcacttttccttcaaaacccagcttctcaaaagagttgtccatgctttatttcatcaacttccactcactcagtctatggcttgtgccaataaattgctcttagggcatgaatctatttattgctcaatctgttggactaatttcttcactgctttatttggcagtaattagcattgctgattttcttgcctttgaaacactttgcctaacttctgtgatttcatattcttccatttttacatctgctctttgggctgaattctccatattatgcaagttcccctttcttaggcttccctttaattgttagtatttttgtttttctttttttttttttttgagtccgagtcttgctgtgtcgcccaggctggagtgcagtggcgcgatctcggctcactgcaacttctgcctcccgggttcaagtgattctcctgcctcagcctcccaagtagctgagactacaggcgcccgccagcacgcccggctaatttttgtatttttagtagagacggggtttcaccatattggtcaggctggtctcgaactcctgaccttgtgatgcgcatgatggttcatgtctataatcccagcactttgggaggctgaggcaggcagattgcttaagcccaagagtttgagactagcctgggcaacaatgtgagaacttatctctaaaaaaatgtaaaaaattagttgggcatggtggtgtgtgcctgtagtcccagctactcaggaggttgagatgggagaatcacctgagcctgggagtttgaggctgtagtgagctgggtcatgccagtgcactccatcctgggcaaaagagtgagaccctgtctcaaaaaaaaaaaaaaaccccaaaacaaaaatcagcttttaagttatctttttagtgaataattctttcttctaagaaagctcaagtctttcattttttgagtccttagtataatatatctacatttccatagtacccactaataataatacattgcatttgtttgtctatggctgactttcctataagaccaaagctccttgaaggcaggaccgaatttttaattcctatttgaatctccattgtttttcttaatgtttagtacttaggtctcctagacagcaggtctgttattttgtcatcaacctttggatcctgtctagtccgttaagaaaacttgtaatctaaacataatgttctgggttgtagagagtacttcttttgatatgcatagtatacttcttgtaatgtaatgctttgaaatcagtttagttgtttttataaagcagacattgagcttatgttcagataaaaaccacatttttttcgcatttggaattctgattttttaaacctaagtgactttgaacctttattcttgctttaatttaatcttgttcactcatactcattattccaatctatatcttagtcttgattctgtcactcttatacttaactgcttttacttttcatagttcgtaaattttggaagtatgacaattaaggcatgcagtcccatcatctgatctgatcttggttaagcaaacttctgttgtcattcacgtcattagtacaaatttttgaccaggatgaaacatcgaaagccatctgacagtacagtctttcaccagttataaacacctttgatgtttattcatcttcgtttctccatcgcatctacaaggatatcatgagattttcttaaaattttttttaacaccttgctgatatcaaaatatactacattcaccagtccagaaacccttcagaaagtaagagtggtttatgtgacctgtttggaacacttgtggtagtgtctactgattgtgaaaccagctgattaataatgtcttctagtatttagcagaatctcttcttttccatttttgaaaatttaggcatatttgcctgtctgccaccttttggcagttcccttgtgctaagtaagttcccagagttcactgagagtgcctgttttgtcatactctaattgggttgatgggagaattaactttttttttttttttttttttttttgagatggagtctcgctctgtagccccggctggaatacagtggcatgatctcggctcactgcagcctccacctcccaggtcccagttcaagcaattctcctgcctcagcctcctgagtagctgggattacaggcacgcaccaccatacccagataatttttctttgtatttttagtagggacggggtttcaccatgttggccaggctggtcttgaactcctgacctcatgatccgtctgcctcggcctcccaaagtgctgggattacaggcatgagccaccacacccagccgggaattaactctttaaaaatgaccagttgttcttaatcttgggcgttgcctcttggttaataatatttcttctgttcattctactttgttctcatagttggataaaacaagaaaaaaggaataacatttactttcttttgttggtcattataatatctcgaagcaataattctatttcttcattctcagcagttttgctttaggttttttataagccttgagtcttttgacacaatgatttagatacctgttactgtattgaattagtttttacatgtctttttaaaaacttattagagaatttactgtgtagtcatgatatctatttattttcttgtaaagattattcacataactgtattttcatttttaatatcttgcctttcttccagtccagtttagtgtagtgttaaaaaacatcttttttggaattgaacagatttaaatttgaatttcaactctgcctcttactgacttatgttcttgttaatgagccactctgaaccagttggtttgtcatcaaaaaggggataaaaataactaacttacaggagtattgctgggatttaatacatttaaaacacttaatgcagtgcctggcatttagtaagctctaagtaagtggtagatgctattgagttttcctatctataagtattttgaaatcagttttcctaaagagtagggcacttgtctatgctcatcactccctactttgaattagactccaagatgatgtttcttatttccacactcccattatttcccctctatttacttctatcccagtttccaagaatggtcctttcttttgtcttgtttgctttttaaacagctttattgagatatagttcacatatcagttcacccatttaaaatgtacaattcaaaggtttttagtatattcatagagttgtagagctgttaccattgtctaactctagaacattttcatcaccctaaaagaaacttgctacccattagcagtcattctccatttctccctttgctcagcccctggaaaccactaattctactgtgtctatgaatttgcatattgtggacatttcatataaatgaaatcatacaatattattttgtgtgtgctctctttacatagcataatgttcttatggttcatccaagttgtagcatgtatctatacttcatttctttatctggctaaatatctcattctatggatatggcacattttgtttatccattcatcatgggtggacatttgggttgtttctactttcagactattatgaatgacactgctatgtctatttgtgtacaagtttttgtgtggttatctgttttcatttctcttgggtatataactggatgtgtaattgttgggtcatatggtaattattttaacttctcaaggaacaccgttacacttttccatacaatcccaccagcaacgtaaatttttgttgctctgcttttccactgacacttggtattgtcattttttttaaaaaattgagctattctagtggttgtgtagtagtaactcactgtggggtttttttttctatttttattttttaaattgctatgtaatagatgtacttttttcaaggtacatgtgataatttgatatattcatataattaaatcagggtaattaggctatccatcacctcgaacattttttttaatgctaggaatattgaattattctcttctagctattttgaaatgtgtaattgattgttacctatagtcaaccctgcattaacaccagctcttatttattctgtctaattgtatatttgtactgatgaatcaacctctcttcattcctcttctccccctagccttcccagcctctggtaaccatcattttgctctctatctccatgagttcagtttgtttgtttttttttttagctcccacatgttagaacatgcgatatttgtcttcctgtgcttagcttattttgcttaacatgctgtcttccagttccatctgttctgttgcaaatgacagaatttcattcttttttatggctgaataatattccattgtgtatatgtaccacattttctttgtttgtctgctgatggacacttgagttaattctgtgtcttggctattgtgaatagtgctgcagtaaacataaagcgcagatacctcttcaatatattgatttcctttcttttggatatatacccagtagtggaattgctggctcatattgtagttttatttttagttttttgaggaaccttcatactgttttccacagtggctgtactaacttacattcccactaacagtgtatgagggttctcctttctccacatccttgtcagcatttgttattgcgatctttttgataaaagccattttaactggggtgagatgatagctcattgtgattttgacttgcatttctctggtgattaataatgttgaacattttttcatacatgtattggctatttgaatgttttcttttgagaaatgtctattcggatctggtgctcattttaaaattgaatttttttgagctccttatgtattctgattattaatcctttgtcggatagtttgcaaatattttcttcctttctgtgggttgtctctttgtggactgtttccttggctgtgcaaaagttttttaacttaatgtaatcccatttgtctgtttttgctttagttgcctatgcttttgaggtcttacacagtaagtctttgcccagaccagtgtcctggagcatttctccaatgttttcttacagtaatttcatagtttcagattttagatttaagtctttaatccattttgatttgacttttgtatatggtaagagataggggtctagtttcattcttccgcatacggttatccagttttcccagcaccatttatcgatgagactgccttttcctcactgtgtttgtggtacctttgttgaaaatgagttagccgaaaatgtgtggatttatatttgggttttttattttgttccattggtctgtgtgtctttttatgccagtactatgctattttggttactatagctttttagtaaattttgaagccggttaatatgatgtttccagctttcttctttttattcaggattactttggcagttgaatatcattggtagtttagtagggattgcattgaatctgtaaattaccttgggtagtattgtcattttaacgatattaatttttccagtccatgaacatgaactattttttgtgtcctcttcaatttgtttcatcagtgttttttagttttttattgtatagatctttcacatctttggctaaattgattcttaggtattttatattcattatagctattgcaaatgggattgctttttttttttcttttttagattgtccactgttggtgtatataaatgctactgatttttgtatgttgattttgtatcctgcaactttactgaattagtttgtaagtttaatagttttttggtggagtctttaggtttttctaaatataagatcatgtagtctgcacaaaagattaatttgacttcttccttttcaattcgaatgccctttgtttctttctcctctacaattgctgaggccaggacttccagtactatgttgaataaaagtggtgaaaaatgggcattcttgtattgttccagatattagaggaaaggctttcaattttttcccattcagtatgatgttggccatgagtttgtcttattattttgaggtgtgtccctcctatatccagttttttgagggtttttatcatgaagggatattgaatttttattaaaggctttttcagcatctgttgaagtgatcatatggtttttgttcttggttctgttaatgtgatgaatcatgtttattgatttacatatgttgaatcatccttgcatctctgggatgaatcctgcttgatcatggtgaatgatctttttatgtgttgttgaattcaattcattgtggttttaacttagatttctctaatgacttacggggttgagcattttttaatgtacttacgtgccatctctatatcttccctcttcagacatttgtccattttttattgaatttttcttattgaatttggagaattctttatatattctggatataaatcccttatcagatagaagttttgtaatttttttccccagtctgtggcttctgtttttgtgttctcaatgttatctaagactttctaattttgacaaagtccaatttatcatttttcttttatggattgtgctgttggtgttacatcaaagaaatcttcgcctaactcaaggtcacttctaggatttcttctcctaggtgttcttctggaagtttcatagtattggattttacatttaggtccatgatccattttgagttaacttttatatatacgtattgttagatttttagtgtcactatattgcctctagttaactcagtcttcatactagaaattaatgagattttttaaatgaacgcccacacctaatttagggaaggtaaacttttatagttcatttgaattaccagatgattttaatatacattcttgcaaaggatatgttcatggtttttcatatttaatgctgtgaaattatgttcatcttgccagttatgtattgtttaatatataattatttagaagttatactaattgtcaaaatgttaaaataaactagcattcagtttaaattataatttgaatgaaaaagtaaacatttgtcctttgttgagaaaagaaaataggaagccagtttaatattctgcaaacatcagtgatttagtaacctgtttccttttcctcaagacttttgtacttgctgtttccctctgcctagagcaacactcttgccccagttaactgggtagttcattgcctcactccttcaagttttgtgcaaatgtcactcccagtgaggctttccccaaacgtgctatttaaaattgtaatcccagtaatcagtggtcctagttctacttcctgttttatttttcctgtagcactttattctctgttatgaattttacatatttgtctatgtcccctgccagaatataagatccctgagaacagagatttttgctttgtttactaatgtatgcctagaagctaaaatattgcctaccatgtagtagatgttcaacaaatgttgaatgagtaagttaataaatgtatgaagttatacatatttaacacagggtcaattttaaacctcggagcttctcataggaacatactagcgaaagaagaaaatgttttacaataaattattaagatgatttcgtaaacatttgctatagaaacttttatgattattgggtttttttaatttatttgcagggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttcgtaagtatacatcatttgtttttgatgtatcatccctgtctctttaagcaaaacactcaagtttcaaaatcagtttagcaaatatagggttttttctaacttaaggtcattttattacttaatataactcagttgcttatcaaattattgcattagcacattgaaatttatgattaggttaatgctagaaagagaatccaatattctcattgttgtgccttcttatagtacattcagaaaaatttaaattcccaataataagtaaaattgaatcaatatttttaggcagatacatggggaaatcaataataaaagattgcttactatatgtctggtactctactgattaaatactttaatggcatttaacttattgaattagtttttaaataaatatttaaattaaatagttaatagtatttaaatagtttaatgacttttactcaaagataagaagctgaattcattgactaattaatgactaacttgtcacacagctagtgggtggcagtcagtagttgaatttggatttctgtgactcaaagacctgtattcttaactgctgttttattatactgtggtttttgtgagattttaataacagacctctagattttaatgatagatctctttcattgtctgactcttatgtttatattcaaataaacttatattgttaaaaatgtcatcagtgccggctgggcatggtggctcacacctgtaatcccagcattttgggaggctgagatgggcagatcatgaagtcaagagatcaagaccagcctggcaacatggtgaaaccccgtctctactaaaaatacaaaaattagctgggcgtggtggcgcgtgcctgtagtcccagctactagggaggctgaggcaggagaatctctggaacctgggaggtggaggttgcagtgagccgagattgcaccactgtactccagtctggcgacagagcaagactctgtctcaaaaacaaaacaaaacaaaaatgaaaatgtcatcaacacttgagaaattgctggccttaaatttctaagcctatcaatttatgtaggtgtgtatttaacatttatacactgtttgttatctagtattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaagtaagttggataattgtctgcattttcagtaattttaaaattgatttcaaacagtattttgaaaagtaagatttttatgcttaaaatatgtattggctttggggaagaatagtaaacttacaaaatgtaaaataaaaaataactgaattttactcaaagataagctgaattcatagatttttgaagagctgcatttgatgtattttttggtgacttgtttactggaaacttttgttaccataatgtaactgaaggtaagtagctgtgatttcagaaattcattgtgtttcttttgatttctgtggtagtatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagaggtaagtctgaacatgggtggttttaagccaatgtgtgagttgtgccaatgacattggtggttgagaaacagcattttatcattatgctaatatatttaacagctgtgaaatattgtttagcttatatatttttcccttgttagcattataaagagatcattcacagatttatcagcagtaattgagaggaagagaagttgcctatattaaaaaactagtaattccagatcttttatatttggctttgaaatataaccagatggacagacatttgtatttgcttgtattcgtgcctgagatatagttcattaaccagtcttctggtctttcctttccttctatgtgctttgcgaacaattcccttcttgggatttattttctgaacaaatggtagatgattttacaaattggaaagaacttttctggcagttacgtagattctttttttctgactgtcacagggtattgagtacaaagttgggaaattcccatttgctgctaacagcagagctaagacaaatgctgacacagatggcatggtgaagatccttgggcagaaatcgacagacagagtactgggagcacatattcttggaccagtgagtattgtaaaaccagagaaatcccattaagatttctagaaagcattgctgtttattaattataaaccacctggtgttagtctgaggttgctcatttccagcaaaactttgaatatggctctctgtgcatcatttctagaaggataccagcagcactctcacagtcttgcccactgtatcatctactttgtcctgcagccaagattctctctttaaaacatacaccagattatgccccttaaaatcctccagtggtgcttttcaacttcagattgttacatccaaggcctcactgaatctgtttgtgcctacttctctgacctcttctttttctgctctcttttactcattaatgccatgtcacatgggccttctctcattttcacaacagaccaaatatttgcattttagggcctttgtgcttaagataccctctgcttagactgttctgcctccagatctttgaatggctggctccttattattcaggtctcagctcaaatgttacctcctaagggaagcctttcctaccactgagcctaaagtatgtatctttcttgtagatatctcttgtatctgatgtaacaataatgagaatagaatatttgagtgctgtgtcactttagtatacattttgttatttttacatcagctttttgaaataggtgctgttatttttgaggtgaagaaactgaatgaagcacaaagaaccaatgaatggttaaggtagtaagtggtagatatgaattgaaggccctttggctccagagcccaagctcttctgtgtcaccttttctattaagcttttcctgacttttcttcaactgataaagaaacagatttaaggcgtttttaagatctaaaagcttcccctcaacaattgctatcctattagcatgtagtttttgccttggaagcaaatttacttggcttgttattttaaagggtgctggagaaatggtaaatgaagctgctcttgctttggaatatggagcatcctgtgaagatatagctagagtctgtcatgcacatccggtaattattaacaacatatagaattgatggttgcctaaattttcttctgacccacaaatatttggattttaattttaaatttcttcccttgcagaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaatggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattcatttactggttatcatgagtacgtgttgagatggtcatagttttttttatgactacttctagtgtatattctaatttcttttctaggcctgaatgtatctttattttcatgttataggacaatattaaggcattttaaaggtcatcatcctttcatctattttagatacacctactaaatgtttaatatatacttttggagaagtacaacataagggagtctttaatctgtgttttccttgtctgggttaatgactgtttatttaaagagtgctgtaaaattggatgtgtggtgtttaaaatggccatgtcctgaggaaacttaagtaacaaagtactaaatgctaagtaggcttttgcatattgtaactaaatttaagaataattcagattaagtagttctgaaatttggtatagatagcatagattgtctcatgctcatgagtgacataatgaccctggattctgttacatacttctaaagaaaattgattgttgtcttaggaggcagttaacttggctgaacaccaactccacactctgtcttgtttgtaggtggcagcagctgaaatctcttctcagttgttttagctttagctatgctgctggaagtctttcccatgcaagtgtgtagttcaggggtcaaccagagtttgggcagaaggaagtctgccccttctgtgcctcctgttttttgggggtttcccctttatgttccagctgttgtggttgccccatattctgccttctgatccttaaccaataaaacttggcttttgtttccccctcaagtgagaacccgttaaaaatgagacattgagccagtgctgttcactttttaagtgccaacttccctctactttccacttgtttatagttgtttccagtgcctttagttttttctaaaatatatttgttcagagtttgcagttgctatcagcaggagggttggtctgatatctgtgtgctactttgccattattagaagtgaactctgcatctttttaaaaatttgaaatcccggtatcatgtgaagtgctgtttatgtaaatctcaacatatcccttactcagggaaaaaaaagtttttagttagggaatagtgaaatataatttaatatggaattctagctgtagagttaaatccatctttaagtgtttacattcagtatgagaatgcaaatttatctgtatggggaataaagtcctaggaataaaacaagttttaagtgttcacttactgttatctactaagctgtcaatatttttgtggcttgtgaagagtgaaattaattgtccacttcattgaactgattaaaattagtaatttcaactggctgggagcggtggctcactcctgtaatcccagcactttgggaggccggggcgggcagatcacctgcggtcaggagtttgagaccaacctgaccaatgtggtaaaaccccatctctactaaaaatataaaaattagccaggtgtggtggcaggcccctgtaatcccaactactcaggaggctgaggcagaatcacttgaacccaggaggcggtgagctgagatcatgccactgcattctagcctggcgacagagcgaaactccgtctcaaaaaaaaaaaaaaagtaatttcaaagtgagatctttagttgtttagctgaaaaggaatggagagtgtttctactgttctaagtaaaatactacataattgctctagtagatgatggggtatgaccatttttgctagttattgggatttttttttttaattaagttctggggtacatgtgcagaacatgcaggtttgttacataggtatacatgtgccatggtggtttgctgcacccatcaacccatcatctacattaggtatttctcttaatgctatccctcccccacccccatccccttgtccatgtgttttcattgttcacctcccacttacaagtgagaacatgtggtgtttggttttctatttttgtgttagtttgctgagaacgatggtttc

SEQ ID NO: 11759 - DNA, 15164 bp, Human
tctcggctcactgcaacctccacctcccaagttcaaggaattctcctgtttcagcctcccatgtagctgagactacaggcacacgcaaccatgcctagctaatttttttgtattttcagtagagatggggtttcaccatattggtcaggctggtcccaaactcctgacctcaggtgatgcacctgcctcagcctcccaaaatgctggattacaggcatgagccaccatgcccagccagtttctaatgccattttacaatgaaaggaatcagggttcctcgtagaaaataggattctaggactggggcaggaaatacaagatgagcccggagtatcctgtagtgtcagaaaggaaagaggcactcaaacccaaataagctggtatatacactgggtgtatgtcaaaggagcacaaggaaccactcaaattcccagtggccaaaatgagaacaatttgaaaaaaaaattagtactgtagtataacaaaggataaaataacaatggtccacactgatataaatgattgaatacatgggggagaagaaacaaatctcccatgcagaattccaaataatttctgtagatactctgcccccaaggaggtggagcaaaatccccgactccttacgtgtgggctgtgcatggggacgtccttccaaagagtacagtagagaaaagaggggtggggggacctgacaaacactacttcagtcaagtgatcaagtcagcaccaacagtggtaagtaacgttgaacagtaagaacccttccttggtaggatgtgatgagcatagcactttacctctgtgatcttccttccaaaacgccataacgcttgtctaatcctgagaaaaacatcaaatcccaatagagggccagcccaccaaagatttggccagtactcctcaaaactatcaaggtcatcaaaaataaaaagctgaggccaggcgcggtggctcacgcctgtaatcccagcactttgggaggctgagacgggcagatcatgaggtcagatcaagaccatcctggccaacatggtgaaaccccgtctctaccaaaaatacaaaaattagccgggcatggtggtgtgtgcctgtaatcccagctgctcaggaggctgagacaggagaatcgcttgaacctgggaggcagaggttgcagtgagctgagatcatgccactgcactccagctaaaataaaaataaaaggctgagacactgtcattaacagtagtctaagacatgacaacgaaatataatgtggtatcctgaatggaaacctgcagcagaaaaaggcattaagtaaaaggaaggaaatctgaataaactacactttagttaatatgacaacagtgcatcgttaattttaacaaatgtagcacactaataatgtaagattttagtaataggggaaattgcagggatgggtggcacatgggaactctctactatgttctcaatttttctgtaaatctgttctaaaaaataacgtccgttattattattattattattattattatttgcggggaggggacacagtcttgctctgtctcccaggctggagtgcagtggtgagatctcggctcactgcaatctccgcctcctgggttcaagcgattctcatgtgtcagcctccccagtagctagggctacaggtgcctaccaccacacccggctaattttatatttttagtagagacgtggtttcaccatgttggtcaggctggtctcgaactcctgacctcaggtgatccgcccgcctcagcctcccaaagggctgggattacaggcaggagccaccatgcctggcaaaaataacgtccataaacaaaaacacgtggccaacaggggcggagcagaaccgagtttccggaagcaaaacagggctttgtaccgaacaaagatggcggccgccggcgtcgggaggagggctgccctaaagaaagatggcctccgcgagaggaggaaccggaagcgtgggtctggcggctgcaccggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggagggtaggctggggcgggggctggaggctggggctggggctggggctgggcgatggcactagggctgaactaggaccagggcatggagaatggaggatggaggccgggggatggcaccagggccgggctaggactagggctggagcggggcctgggggctggggctgggcgatggcactagggccgggttggggctggggctgggggatggagcggggcccgggggctgggggtggggctgggggatcgcactagggctgggttaagaccagggcggttggctggggctaggggattgaggatggtggatggaggctgggggatggcagtagggccgggctaggactggggctggagcggagtttgggggctggggctcaggagcgggggctggggctggggctggggctgggggatggcactagggccaggccggggtaggggtcacatcccaggagggccgggcctgggcagagctgagtccgcgggggccggaccccggaagccaagcggccggcctgcaggatgaggcctggctcctcggccatgaccacagacgtgccagacttaagtcggagacctgaggagccaggctgcaggttggcctactttgcgctaagctgggggtggaccagtggtaacctccctccgaagtgggttctgcctcctttctagcctagcgggagacaggaaggatggtgaggactcttccgcagccgaccaggagggaccaaactgtttcctttcccggctctgccttggggtgggaggagcagcacaggggttaggggtgcaaactggtggcagtggcagtggcaccaaggggcttttcgggaaggagtcgggccagggctttagaataggcaggaccagcaaagggagggctccctggaccgccgtcccctctgggccaggagcttacagaccgcagtacttgaggtttcgcaaggtgcttggagggcgtctagacggctttgctggctttcttatgggctgtaaatgtggctacattttgccgctgtttcttccccactcctgattggctttgtctttcccagcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggcaaggatggaagtttggaatcccttcctggatgtcatcgggtttggggtctctttgttgtgggatgagatttgggagttctatgttgaaatgagtgagcccggaaaacggttcatgtctcagttccccttggaaaggtgtagaagttaagagtttgagatgcgtggagcagttaataccatcaaagctttgtggtgggttctgaaaatcggtccagtgagtatgtagggtcatgggattttagaggtggacatgatcaaatccatcttagagatcaacacatctcactcatttttttatttttttctttattttgagacggagtttcactcttcttacccgggctggagtgcaatggcatgatctcagctcactgcaacctctgcctcccggttgaagcaattatcctgcctcagcctcccgggtagctgggattacagggtcctgccaccatgcccagctaatttttgtatttttagtagagatggggttttgccaacttggccaggctggtctcgaactcctgatctcaggtgatgtgcctgcctcagcttcccgaagtgctgggattacaggcgtgagccaccatgcctggccacatctcactcattttgtgaaagaggaaacatgtagagtcctaagtttgttgaacctactgttgtaaactgcctttttttttttttctttgagtcagggtctcactctgttgtccaggctggagtgcagtgacgccatctcagctcactacagcctccaccttcccggttcaagcgattctcctgcctcagcctcccaagtagctgtgactacaggcatgtgccaccacagccggctaatttttgtatttctagtagagatggggtttcctcacattggccaggctggtctcgaactcctgacctcaagtgatctgcctacctcagcctcccagagtgctaggattacaggcgtgagccaccttgcccagccgcaaacagcttttatggttgaactcactgatgagcagcttgggctttggcagcagacacatctggatttgagtcctaacactctcccagctccgtagtcttaggaaagttgcctgacctgagactcagattctgacttacaaagtgttgcttgtaacaatccagggagctctgtctgtcaagtgcataacatgtacctggtgcatgttacaaataaatgttaactgttgccttttagatccttgtagcagacctgcaagatgggcaaaacagtcaattatttatttatttatttttgagactgagtttcattcttgtcacccaggctggagtgcagtagcaccatctggatcttgatctcggctcaccgcaaactctgcctcccggattcaagtgattctgctgcctcagcctcccaagtagctggtattacaggcacctgccaccacacccagctaatttttgtatttttaatagagacagggtttcaccttgttggccaggctggtctcaaactcctgacctcaaggtcatccagctgtctctacttcccaaagtgctgaaattacaggtatgagccaccatgcctggcctcaatcagttatttatccctgactgtatctatggaaaaatgtgaacacatttttcccttctgtctgggtgagcgtgtgggtcacccactgtccagcggttctgtactaaaatgcgaatgttccacgggtgtggtggctcatgcctataattctagcactacgggaagccaaaaccggctgatcccttgagctcaagagttccagaccagcctggggaacatggtgaaaccccatctctactaaaaaaatacaaaaaaattagtcaggcatggtggcatgcacctgtagtcccagctacttagggggctgaggcagaaggatggcttgaacctgggaggtcgaggctgcagtgagcagacagccactgcagtccagcctgggtgacggagtgagaccctgtcccaaacaaacaagaaccattctagacgaatcaggataagttgatcatcttagaattgaggcttcactaacaataactgtgactttgggcaaagttacttcacttgtctgtgcctcagttttctcatttgtaaaagaaggagcacaatggtaactaccgtgatgggttttgggaggtcacagtaaaatgttctatgaacagaccaggtgtggtggctcgcgcctgtaatcccagcactttgggaggccgaagcgggtggatcacaaggtcaagagttcaagaccagcctggccaagatggtgaaaccccatctctactaaaaatacaaaaattagctgggcgtggtggcaggtgcctgtagtctcagctactcagggggctgaggcaagggaatcgcttgaatctgggaggcagaggttgcagtgagctgagatcatgtcattgcactccagtctgggtaacagagcgagactgtcaaaaaaaaaaagttatatgaacagtgcttagaatattgttgttcccatagtgaacactcagtgcatgttccctgttattgcatataagtttggtcaccagagtgagaaaccttggctgctggagcctaacaggtctgagtgaatccttgtttattttatttatttattttattttattttatttatttattattattattattttttttttttgagacggagtcttgctctgtctcccaggctggagtgctggagtgcagtggggtgatcttagctcactgcaacctccacctcccaggttccagcgattctcaagcctcagcctcccaagtacctgggattacaggcgcctgccactatgcctggctaatttttgtatttttttttttaatggagtcttgctctgtcgccacgctggagtgcaatggcttgatcttggctcaccgcaacctccgcctcccaggttcatgcaattctacctcagcctcctgagtagctgggactataagcacctgccaccatacccagctaatttttttgtattttttttagtagagaccaggtttcaccatgttggccaggctggtcttgaactcctgacctcaggtgatccacccactttggcctcccaaagtgctgggattacaggcatgaaccaccatgcctggccctaatttttgtattttaatagagatggggtttcaccatgttggccaggctggtctcaaacccctgacctcaacttatccgtctgcctcagcctcccaaagtgctgggattacaggtgtgagccaccatgcccgaccccaccccctttttaaataaaaatcagtatcctcatgacatcccacattgcccctttgatgacaaaagagcagcatctctgacagcatccgtgtggcatctcgcagtgcgggaaccgtaaccaaagtatcgggctttggagtgagacaggactgggttcaggtcccagctctgccacatatagtcttgggcaagtggagtaagcgctctctgtgcctcagttccctcatctgtaaaatgagaacgatagtgcccactccatggggttggtaggaacaaagaagattttgggcatgtaaagttcttagtgccgagtgcacagtggtctgtaagtgaagctgcggttcttagtggtagaaggagctgattgatggccctggctgagaactttgtgttcgctttttccccttttaattcaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcaggtaaggtcagggctaggacatgatggatgggccccgagcccaagcctctgagctccaggagaaaaccctgtccttacccactgggattgttttgcagcaatgctggagcagaaaggatcacagatgtggctttggatttctggaggagtggaaagcagagggaagacatcaagctcaaagacattgaacacgcgttgtctgtgtcggttttcaataacaagaacagtgagtagggccatccaccgccagtcccatctggttcctaatcctgcaccctaagtgttaaaagcatcagggtcactgtcagcatcacctgggagctgggtagaaagaaatgcagattctcagtccccttccgagtcatgaggggaatctttgctgatgaactccaggtaacttttatgaacactaatgtttgacaagtgctgttttatttttatttttcagatagttttactctgtcacctaggctggagtgcagtggcgtaaccttgcctcactgcaacctctgcctcccgggctcaagcgattcttgtgcctcagcctcctgagtagctgggattacaggtgcacaccatgcccagctaatatttgtatttttagtagagatggggttttgtcatgttggccaggctggtcttgaactcttacctcaggtgatccgcccacctcggcctcccaaagtgctgggattacaggcgtgagccactgtgctcagcttattttttgagacagagtctcactctgtcacccaggctggagtccagtggtgtgatctcagctcactggagtcttgacttcctaggctcaagtgatcctccagcctcagcttcccatgtaggtggaaccacaggcttgcgccaccatgcctggctaatttttttttttttttttggtagagactgggtcttcctatgtttcccaggctggtcttgacttcctggacttaagtcatcctcccgcctcagcctcccaaagtgctggaattataggcatgagctacatacctggcctgctgtttttttttttttttgagatggagtctcgctctgttgcccaggctggagtgcagtggcgcgatctcggctcactgcaagctctgcctcccaggttcacaccattctcctgcctcagcctgccgagtagctgggactacaggcacctgccaccacactcggcaaattttttgtatttttagtagaaacggggtttcaccatgttagccaggatggtcttatctcctgacctcgtgatccgcctgcctcggcctcccaaagtgctgggattacaggcgtgagccaccacgcctggccagttcccccattttcttcagctacatgattttctttgtagaagaaagagccagtggttgagcaaggaaggatgccgtgggcagctcagggggagagatgacctgttagttcctccctttctctgcattgcccaagagcaacagccaaatagcggttcggcccttattttgtactgggcaccgtgtgaaacagcctgcctgcggatttcactcagtcttcaccatacctcgcagggtagagactgagactcagagatgtggcagcttgcccagggccatgcagcctgttcggtatctctgattctaaaacctgagcttttaagttttagctcactacttctccaaatgtcatgagacctttgaccttgaacctggggaggtggaaagccagcctgatggaggctgactcactggctaagacctgtgagttgtgcagggctggctgttcaagtctttgcgcttcaggttctggagatgacaaaacagaagggctcatttgaaacagacttgccaagaaattaatcctacagttagtgaacagcatggggtacagtatgtcagtgtgtgcaagtggaatactactgaggaaagacaagtattttgtaacatgttggatagtttcttgccttgccaaaaaacatgagcacatgcagtggaaactttagcctaatgctgaggcagatgagccccgtggcctagaatccacgctgtggaggttacacggtgcttaggagtgccaacctgggagtcgggcagccctggcccacagactgactgtgacctcaggcagatggctgaacattgattcagcacatgtatatggagcatctggtaagtgccaggcatcatacctaggacgggggacacagcagtgaacaaacacagaaattcttgcccttatcaatcctacatcctagtgataataaagaaagaaaatgtatcagatgatgggggatagatatgttgatgtgtgtgatgtgtttgtgtgtatacatgcagtacatatgcacacatcgcacatgtacacatgtggacatatagatatctttccccccggggccagtaggggaaaaaaatcaagaaaggctttggggttcagggtaaggatgggctctgctttaatagagtggacagggaaggctccctgtgagggtggcatttgggctgacccgagggagtgagccatgtggatgtctgagggaaaagcattccccagtgcggacagcacgtccaggggcccgaggggggcctgtgcttggggtccctgtgactggttgaggataaacagaggagggaaacgggaggtgatagaagaggcgagatttggggtggaggtgcagaccgtgggaagcctggcgggccatggtgaaccttgagtcttattccaagtggaagagagaggcctggagggtcccgggcaggtggtgctgtgatctgacggggccttcacaggaccttgctggcaactgggtggaggacagacccacagccacaggggcagggagcccagcgtggaagcggtgggggtggagggacacggttggcttctgggtgtgttttgaaggtagaacctgtaagacttcctgcagaattgtatatgggaatgagagaagaatcaaggacctggcttgagcgatgggaagggtggcactgccattgaagggaagggacagcaggaaggacgggcgagctcagtgggcaatggcatcagggcatcagagcagagccacgaagctccagggaggccatcaggccaggagggcaaacttgggagtcctcaggagatgactgtgaagtctcagggctgcctgaggtcacctgttctgccgtcactcctgggtctgcgtggctgggtccttgttgctcgggctctgccctgaggtcctgcccagcctgctccacctcccgctctccatgtccgttctgctgtgtggcattcgccactccaagcaccatctgagattgtttcctgccctagagtggtaaagccgtgaggtccgtctgccctcagctgtgtccccaggcccagggcgtgcctggcacagagcaggcctctgagaaccagcctcccacgtgagttcatgatagcaagacagcccctcgttcccattcagtggttggttctgttctttccctggccataggctccactctgtcagtcagccacacatttattgagtaccagttgtgtgcaaagcactgttgggcatgaaaagcattaacccagtgaatgaggaggagcttgggttggggacggagccccagaattacatggcagaccagaagggaatcagctcagtagaagacacgcatgggctcgtgggcgacgcagtgtgtgctgtgtcatctggggctgggaggaagtgtcctgggtcaggagttccaggagcccaggaggagtggacgggtcagtgcagagccagcccgcattcaggggagaaaacacggccaaggccaggccttcacggggagcccagcgtgggctgcacatctgcactctccaggctagttttggtgcccacatgctctgcagggtctgggcactgtggcagcggcagcaggcttccctgttgctagtccagctgctgaaactccagggagagtcaaaaagttcccaaatacagaggcgtggctggtagtccttcccgggaattcttcttgcttcccgctttctgtggaactctgccttccccactctgcctctctgcttgttcctgggccccaggacctctttcccatcttcgatctcttaagtcataccttgggaggcctcccccagcccgccgtgtaaagagggctgtcacagcttctgctgtcacagaagcattacaatgtgcaggtgcctgttaacatctgccttccccactgatctggagctccacaagggagagggcacacccagtaggtatgtgtgggatggataggagggtggatgacacccagtagatgtgtatgggatggataggagggtggatgacacccagtaggtgtgtatgggatggatgggagggtgggtgacccctagtagatgtgtggggggtgggtgggtgacccccagtaggtgtgtgtggcatggataggtgacccccagtagacgtttgtgggacggatgggagggtaggtaagtgacccccaggaggcgtctatagggcaggtgggtggatgtggatgaacagcaccttgtttcttcttcccaggtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatacccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctgggaagtcgccctccattgtggggttcttggagctcctgacacccagccacggagttcaagtacagctgagatgccagcaggaacagtgccgtagactaaggtaagcacaccttattttatccaacatgcctgtgtcccagcacgtgggcagtgctcccatgggtgcggctgctgcagagagcactgcagggaccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtctcctgggaattgagtaacttcagctgagaaaataagggagtgggtggggtgatggtgatgagggtttgtgctttctagtaaatctgctaatccttaatcctgtgaagagggtgggtgttagcaattcactgatgagacaatactggattatgtgtaattaagctgagatcagattagcataactagaattttttttgagacggagtttcactcttactgtccaggctggagtgcaatggcacgatcgcggctcactataacctctgcctcccaggttcaagcgattctcctgcctcagcctccctagtagctgggattacaggcatgtgccaccacacccagctaattttgtatttttagtagagatggggtttctccatgttggtcaggctggtctcaaactccccacctcaggtgacccacccacctcggcctcccaaagtgctggaattacaggtgtgagccaccgcacccggccaggatttatttaccagtttcaatggttaggtttcctcacctgagctcaggttcaggctgtcagaggtgagttttactttaccagtacctcaatttcctcccacgttaattttgggagaaagtccatctctttgatgaaatatccatcagctaatttaacttctatttgtctggggaagagcctttaaggtaaatattgcttctgtatcgcgctgactgcccacccgcctgtcccggatatggtgagtctcacagctgtgctgctgaaattcattctgaactttggaaccaaataaactagaaaaagttagcaagtggcatttcacatgataaaatctagaatttactattttatagtcagtaggtcaataaagctctcgtccacatcttataagggaggtgggggaggcggggtcatgatcaaccatagccttttcaagttacaaatcagtaacggcagtccaaaggtggcaaacatatttattgcctcactgtaaatagagaaaatcttgtcttctctcgaccagatgcccaaaaggttataaaagaagtataacttagctccaatttgaggatatgtactaaaaattttaaacgtcaccttggtgtttttttcaagactaagtgtgataccacgtaaggcatttccatgtcataaattaattctaccatatttttatgtaaaaaatgctgcacgttgttgtgtctgcagctgtgctgtgattatgagacagatacaatgattcacactggctggaagctaagtctcacgtcccagggatcagggcagtccagcccggt

SEQ ID NO: 11760 - DNA, 161124 bp, Human
gtgataatatataagtaacgtacaatttaccattttcacctcttgaagtgtatagctcagtggcgttaagtgcattcacactgttgtgcaaccattatcaccattcatctccagaactttctcatcatcccaggcaaactctgtatccattacacaatagctctccatttcctcctgccctcagcctcaggaaacctcccatctactttctctttctacgcgtttaactactcatatagatggaatcatccaacatttttccttttgtgcctggcttatttcacttgacataatgttttcaaggttcttttatgttttcttatgcgtttttatatctctctatctttgatagcacccaatacatagaagacaatgaatgtttttgtgagtgaaaacataagaccagaaagaaataggatgtcatattctagggacactcaagacactttcttgaggacagaggcactgtagcttggaatttggaagatgaggttggcaaggtgggtggggaaaggatggaaaagtgatacgtttcttgaagcatgtggatttgcttccataagcagtggtggaccagtgggcacccttatctattaaaagaatgattttttttgtgactcgtgtagagcactgtcttagttacctaccccagtggtagataagagaagcggattaaaaagagatctgaacctgaggaaatggagactaccaagttttttgtaaatatgtctgttataacatatattatctagtacttgcgatgcctgtgccaaagcatgctttttggtttagttaagcctacttagctcgctaatttcagtaattttggcttgaattgcaaaaagttgatgggggagatgggggagtctctgacatccttcccccactcacaggtttgaaaaataaaattatgaagagcaaaaggatctttttctgtggtaaattgtacttcatgacaataaacgagttgtggttttagtggttaatttataaattaggccatctggttcttctgtaatctaaagatttttatatatatgtaaaatacaaagttgtcctgggcaactgccaatctataaaggagaaaacatcttgaactctgtggagataataaaaccatattcagctgccaaagtgctgctgacatactgtccaatgagacacccaacgcctttgcattacagccagcaaggtgtggagctagatgtattgatctatttaataatattagcttctcttctctgggtcggacttggcccagagcaagtgaacaggacctatctatctccttctcaaaagtcacagctttcttaccaaattgtacaactcaagccacaaagaaaacaagtcaaggaaaggaccagaggagcacgagggcacatgccttgttcccagaccctgggaccagctccagctctggctccttgcagatcccgctcttctcaagttctctggctttgatcctagttttctgccctactattcctgacatgtacagcacttagcaattcataacttgctttattaaccaatatctcaacagaacttttaaacaacctgggaggaagcagagtgggtgttactgtcctcattgcacagataatgaaactgaggttcagaaaggttgagtgtcttgcccaaggccacacggcttcttagtggagaagccaggatctgcaccaatgtcttccattggacacactgccacttaatatggtacttagtttttctttctagatgaagcagtatgaggaattctaccatggatatctctctctatttttttaaactgcaaaataatgataatgataataatgaatacttctagaatacagtctctatgccaggcactatatgctttatatgtactaacttgcttaattctcctaacaaccctagaaggtagttactaatattatcactatttttaaatggggaaactgagttacagagatggtaaataagttgcccaaggtcacagaggcagccagattagtgacaaaagtttgagagtactcagtttgaattttacatgttccgtggatatggtttatgccaaataccttctcctttctagacctcagtttcctcatgtatcaaacaagtggactgcactatacaactctgaggtcccttctagcctgaagattagagtcttttatgcccacatgatatggaaaacattaatgctggctctttaagactggaaccttgtcatttaaaaaaataagctctactaaatttgcagtaaactgtccaaatacgatctctggtctctgatttgtatctctcacagagcatgatacaatgctagacacatatatactcattaaaaacttgctgaattaaattgtaaaacattcctccagatagaccgtaagggtgagctgatgccctaatatgctcctcagctgctgacttaggacccgtgggtgacaaaccctgtccttgttgttccatctgtgacagtgggcagtgtccaaaatgagtctcttcatcaaaagtgagtccaggaaactggatcagagtaagtaaggagtcttccttgcttctttttctctaaaatacaatacagtgcattctagcaaactaccagcatgcctataaatctcattttaaaaatatcaggaaatagatgctcattgataaagagggtaagaatgagcaagggagagagtcaagcctgtacatttgtgcttagggtattttcatttgagaaattatcattggaaagatcaatttccaaggcaggcgttttgtcttgacttaataaactaatctttatcaataataattaaataatgtcattttcccagatacaaaggggaaaccataatgcctttcatatgccttctcatatcttcagtgtttctcaaacccagctgtggggtctttttagggaagatacaaggagggtgagaccatgtggagcacacactcagcagccactgtgaagtcatgggtcccttgctacctttggaagctgacaatctgcatgaaaagcagcccctaggaacatgggtagtggcccgggatccaaaactcctgaatccataaaagggcttttgacttcttgttccaggacaagtgacatctgacatgcttgcctgcttgtttgcctttcttccttctcctatccgtctttccatccatctgtccatcagtctatctgtccatccagtcatccatccatccttccatccattcgtctattcatccatccgtccttccatccatccatccaagatttattgagcacttacatgacaggaagtatgagacacaaaagaaaattctacacaattctcctagggacatgaactaatggttagcaaaaatatatgggaagtcctgcttcaagtaaaattatgacttaagatatacatcagatatttgaaaaagatatttttaagttcaacattgaaattctaactacattgtgtccttaatttctattttctagttagacttttttgaagatacaaatcatttgaattatcattattattgttacttgattttatttattccacatgaatggtaagaattttaaaggaaggtgggtgccctaaaaatacatttatgccaactggattgaatcaccttgaatcacaatgagtacaacaactgctaatgagctaacacttaatgagtaatgaccaggcaccagacactgttctagcactttatacttactgatttctttactcttcatgataaccctatgaggaaagtgcttttttgttaagctccattttcagctgaagaagctgaggcctggagaagttacatagctttctcatggtgtctccactatgaagtagctgagctgagatctcacccaaggccctgctgggttcaggccacactcttaagtactcacagctgcatcacactgaatatcatctccctgcactgccatttcatttgagcagggctttgcctgtcaagaacattcatatcttttgataaacagtgcattttttccctgatagtctgtatgggacagcctccttgtttgcatctgaaggacagggacttcaggacctcctgctgtggtcaccaaggaatcacattcaaacttctcagcaaggtgttatggtccttctcagtttgcctacgatccattgaggcaaaggtttccttctctcaatacaccctctgctttagccagggggacctcccactgtcctctctatgtgttctatttgttcctgactgttagtacccgcttgtgtggtttccatgatccttcttctgcctggaatgaggctcctcttgagtcctgagagcttcatttctgtctgtcttttgggctgtgccaaagcccctctgccttcgtggactccccactgattcattaccaattttcctctcctctgggctcttcttagattgcaaatggtgcctctggattgggtaccaagacttgcagtgccttattttgataccactaatatgagaccatgttatatgcctcttgagatatcattccctttctagcaatagacagtgataagcatgcgtatagagggtaaacgtaggactttgaggttcatccatctcaatagacaaaagtaaaagtatgctaatttcaatccttcacacagtaaattgaatgtaataggtcttcagtaactatttgaggaatgaaattgttattgatatattgatttaactgagcaaatccataagtgccacgcttggagtaaagtacagggaatctcattttttgggtaatttcaaacaagtaggagaccatccactatctattaaggacaaaggagatttgagtgacaaacatgttccagaccatccaatggtgttattctactacttcatcccagctagtaaaatggggcaataagaaccaaaaagcaggtactgtccctatgtaagtagacttcctagtcctggccaaaacaaaaacaaaaaaaaaacaaagcaacacaaaacaaaaacaatgtgtgaagagcatcttaccgttcattgctttggatgatttgtgcaaatctagttaatgggggtggatctgatcagtctttgtaggaagtcagtattggcatatgtctggcttctgaattttctaaaaatataattatttatttttaaatccattcaatcaacactgaatttactaatcaactactaaataagtaaaagatcctatagtagatccttcaagaaatggaaattgagacattaggtcactataaaccccaacccttgtaatctttttgtggcaaccttaggaaacttggaatgctttttacactctgataaaggtttaattgtaatcatagccccagtgttgcaaaatgagtcagaagatacaaagtatctcataggataatattatagctgtaggtacttcaaatggacaagtataacacattatgactgctaatatggatgcattgggaggaaaataagccctaagaagcaatatgcagaaaagctatgattgctggagacagatagatccaagaacctaggtaatttttcagcaaactgtggttccactttcgcctctttcttgacattgactgtgtttttaacagggaaaaagttatctgaaatttttgatagagttcaaactttaaatcgtgttcactttgctaaaactccactggatggagtggcagaagagaaaaaacacagaaataaaagaaaagcagtaatggagaatggaaaatctttaaagatgctaccatcctgaaaagattcgaaagcaagcccaggaaagccacggggagggaaagagcgcttagaggtgtccccaaagctttcagaagtgatgagggaaaccccagctcttcttgttacttcttggcattttgttcctctatacgttagcttttggttaatctttcatgttacttattatctctgttttaaaatttcacattaactcattggtttcatatcccacttaacaaattagatattttccttgggcttattaagaaaattatttgctctcatatgttatggctttagattttctgtgtagctaggactgttcttaaatttttatctttacctttgttatttctctgaagcatccccattggggtggcagtggggggtattaaatggttatgtaaaatttacatgtaattgtgcaatttacacatagcctcaaatataatgaggcctagtctagctgcccataccaagaggatattatagttgccaataaaatcagtattatttcttttttttttctgttcttttttagcttcttgcaaacattcactcagaatcctttttgaatatcagttttgtgaaaagcaccgtgctgggttctttgggaaaagccaagatgagggcaaatgcatcctccttcctagtgagtctagcacacagatgactcaggaagtcatgcactggaggaggagtatcttctagaactggggaaaggttaaggaagggatcagaaacctttttcactcaaccaattacattttcctgaaagcatgttattaatcgtacatgatcttgcagaccccagatagagactatatcactatatcaattgttttcttgaacaactggagttaattctcatatgtttggttacccttcaagtatttatgtttaggatctgttttcttcctcttaacttacattccaaagtttaggtatccttcccctccatttgctgtccaaaacagcatcctttcatgtagctacatgccattggaatgatttggtttttgccatggattcctagtcctaaatttggacttttattggtatctaagatgtcatggacagaacccacagatgttgtacaaaaagggctgagtggacagtccaacagagttacatcatctgttccaaacacccttgtaatggttgtatcagcgtcaatgtctgagttgctgtcctggttctcctggccagtcctcagctggccatgcctgttcaggcaccagagaaagcttcatacctcaggcaaatctttacaagggatttgaaaggcaagaaacatgtattttggaggttttacctgtttatttcatgtatagcttcatattaacagattttgctatcacttaaaagtaaataaaatgattttgatttctcaaaatcatcttataatttattaatctattttaaggcttgcatttacatttaatcttcaaatcttgatgcattttcacagagtttctttagttagttaaggatattaatgacttcctttaatagttgatgaagtgagtcatcatcgacagtgagtcactaaggccaactcttgtacctgctcttaaatagcagttgttttactagatttgtactgaaacctttttaaaaatctgtttgtcttatatataacaagcatttccagtagttaataatactttcttagctcttcaatcattttatgagagcattacaagaaaagcaggagatggggaaagagatatcttgtttgccatgtaggatgcatgaaattcttacttagtctgttgtgttttggattcgagagaaaatatgtaatgaatcaaaatgtttcctacagtcctctgaaaagatgtaatgagacagtcttccagcagcctttgatcatctgggaagtcattgactttgatccttatcctatcaggggctcttaccctggggtccataaatacccaggcatttttaagaagtggatttcagtataacttgtttcattttgtgatttttaaaaatattttgttttatgcacttaaaaccttaatctgagaagtcatctgtagactataccagatttccaaatggaataaaaatatttaagaactctcttatgtgtgtgtttcaacctataaattttatatgtgtagctcatggttaggtggtaagtagagaatttgctatctgtgtaatatttggtactttttataatgaaaaaggaagtaatacaatgataggtaccatttatttgttgaccacccatattttccagggaatgtgatagatactttttatatattctttctagttttcaccataacatgctgcagggatagtgttaccattctcattttgcagatgaagaaattgaaacccagaacaattcgttcattcattcaaaaaatatccatagagcatacactaagagaaggcactctgctaggcaccagaaattgaataattgaccccaaatcacctaactcataagtggcaaagctggacctaacaaagcccattatcccttctatcacacattccatcctcataatatcatattctacatagaaaaacttaacagtcctgttgagacacttggaactctaagaaggtagtcaacagatacttttctctttatataaatatgatatctaattagcttttcctggaaaggagtgattctgcctttttttaattctagcattccctgagcaaattagagcccaggtaatgatttcctgagataagtcaattctcttctaggacaatctctagtcttgtcatcatgagatggaataacaacggtctatgtcatttcagtgacggcacctgcatgtccttgtatctaagaaaagacacctccttctctgccttgctaaatatttgtaaactttgctttaattggtatatgtgccactgttttgtatgtgggaggggtttatggttttgttttgttttttggtcttttttagtaaccccaatccaaactattctcatttgtaacctaaaatacttagaacaagaggctttgcaatcttgaagaccgaatacatttttactactaaatgtaaggcagatttgagccacccattttgtagtgcttgattatggcaacccgaggaaactaatacggttactctttatctttattaggaaatactgctgtagttcctgttgtaatccttagggagccaacattgttgatgagacctagtaccaagccagaggccatgttgaactagcaagatatgggatagtttttactttcaaagtaattagcatctagagtctagagagtttctcttacagggtggcctggtgtcttagtctattttctgttcctataatagaatacctgagactgggtaatgtacaaattataaagatttgtttgactcacaatcctagaggctgggaggttcaagatcagacagccacatctggccatcctttaatgagggcctcatgctgtgtcataacacagcagagaattggaaggagaaatgggcacatgcaaagagaaagaaaggggacgaaaggggctaactcactttgtaactatgagactaatccattccctggagaactaatttattctcatgagaaagacatgaatacatcttaacatcctaatcacttcttaaaggcctcaactctgtacactgctacattgtaacaggcaattaaatttcagcatgagttttggtggggacaaactacatcccaactgtagtacctagctacccactttatttttagagtggctatttaatgacctggcaagatctactgtgcttgtaaaagaatccaccatgggttaaagaaaaatagtttctggcttccagtctccttttggcctctctctagaatggcatatacaagttcagtggttactgacttcaaaggtggggtggaagacactgaaatgaatttttctcctttctttggttggttgctctctctctttgttgctgaaatttgtgtaggataatggaatgaatatgggagatagggaactatagaaagactggagggaagggagaagtcttttctgaattaaccccccatgtgcttgtgagacccttggaccccaaagggctcctgactggctgggcccactccttctgtatatggagccatagggcttttctctggcttcccagttgaagcattgtcatatgctttgatgctcagcatttctggcaattttaccttgtaaaactcccgtttcgacattctgaacttaagtagaaaatgggaatataagcctcttgttttttgctcttaatccattccagaactataagtccctgggttcttggcaacaacaggtgttcctctagattttaaatcaagtgtgtgtgtgtgtgtgtgtgtgtgtgtgtgtgtgtggaatatctcactaaaacgacagtgttgtcatcaattttggcttcatggagggtcttgagctgggtggagatgggaggaagctatccttgtccatgcggtttggagacttgctctaaaaaagagaccgtctacttccctcgtagtttttgttttgaagacatttgtagtgtttaccaggagcatacagttatctggaaaatgcagactgatgacaatagtatttgaaatgctcgtagatctgcttctaggttgatggaaagaatgtatgttccaaggtacaagtgcttgttgacttttcggatgcagccagtctgtgctctttgtcaggtaactcggaatcactccacagtagctgtccttcctgtccatttgacaagcacttaaaagggcagtcttaagtactttacttcatagtttattaattttttcccttctttagtttgcaatctactctcagaaactgaaaaataatttcttttacctttttcccctttctcatttaagctgaaattgatttctttctgagcgtgtaaggaaaaaaataaaaagaagctgtggttaatacaattgcctttgctgaacaaaaataaaagactagtttaccttcaagctgtgctgtatcagagtaaggatctgttctgtcactcccaggagattttgataagagagagtacaaaatttcataatatctacatagcataattgtagcaaatataagaagtattataattgtttatttggggatgagggtggggatgggtttttttgtgtgtgtttggaaaattgggaagctagaagatactcttaaatccatcagcttcttcagaactcttctcaaatgcttattgtcatgacaaccatctcttcataaaccaaggctctgagtgtaatacagatggggctggtaacaaggtaggattgccatctgctttgttttctctaagggacattatttttttgtgatccccaagtctcatcctcaaatctgaaagtcttgacttatttttctttctggagtcagatagagctgtgagattaattcttttctcctgacaaactacttcctcacctgtcatcaaacaacttacttgttaaatggagggaaaaaagggtaattatgtgtgtgtgtgtgtgtgtgtgtgtgtgtgtgtgaaaacaaatatacatattttaatgatttatttatctgtctactttgcaaagtctcctatgaggtacctagtaattcaataatacagtcaagtgtgagatccagaaacaagtaggagtgaggcaatcattttcccatgaaacaagtaaaattattactgcttttgaacattttaacacctgtgcttcctgatggtggggctgcatgaagtttgtaagtagtgtcatcattctcttattaggtaacaaataggagcataattatttaggagaggaaaaccttttcttgttaccaaatttggtgagaaatttgccaaagaaatgaatgcttacaggagggatacagcttaatatcttcatactcccctttgtcaaagatacaaatgacattttctcatatcaacttcctacaaaaagtgaggccatacatttttaaaaagaatatacccagtattttaaaagtttgtatatatcgtgatcagaattaagatatatccagcttttgaaaaaatatacatatttagccattaaaaggtatgtggtaaactaaactgatgaataaaggttatgggaaatatttcataaaatttatatttaaagtaaagaacaatttctctctttgtattatagttattttacataagctacaatctataattctaaaccttaatttcttgaagggctttataagcctcatttttctttctaaatagagaagttcatacactgcttttatgtcctatatgttgatgtgtaaaaataatcaaatactagtgggtgagtagaatgtaactacaatatggtacacacacagacacacaggatgactaaactgtgcacatgagctgatgtccagagcagggaaaagctgctaaagaatgtttgaagtagagtcagaatgcagttttgtggttaagaccaataatttttcaaaggagcattataaggagtgtggttacttgggttggagttgaaaaccaagcaacagttgggcagactggaaaccagttttgtctttaggtttcttttcttaatgattggtctacaatgagttagccactcatcgtatttaaggtcttggtaaaggagagactttctttgccatgtagtttatacctcatgtatgcattacagtagagagctccaggaaatactgcaggccttctactggtttttatcctctatttagataaaaatgaggaagaagtagaattatcataaacaatcctgttggcttttagttgagatatactacagaaacatcacctttgaatctgtatatgtaaaaaaaaaaaatctcagagtaagatataagttctgttgcattgttctgaaggaatgggtaatgtcagaaatgtcttcattacattacataaagtaatacacagtgctgttatcagattgcatagtcaaagttggcaagtttgcatatttacatagatatcatgaccttcatcattcatacttctttcaagaaatggtcatcttaatatggggtatttatttgaggcatacaccatttattttaagaagcagtacctttgtttattgtaaaacttctggactaaattcttcaattttttctcaaatgaattcagttttttgttttttttcttaccactggtttttactgcatagcgtttgcctgaagaacaccactttgtttcccaaggcaagtagtcactacaaggcgagttttgttctgtctatcccaaggcaaatagacagcagcaaacatagtgtggagggctgctgggttcagtagaaaaccatcaactatttctaattgggggtgtatgaagacagctgcattctggacatgctaaacatcttgaaatgcttggagtgtaataaaaccccaaacgtgctttcttttctcatttctttgcacatgtattttaggcaaaatataatccacatgctgttgttccctctccttttaaatcatgaaaaatgttgtttttatagggctatttgaggtccaggatgcctttttatcctttttattaggttatttttatatataaatgaaaagaaaaacataaacagaaaatacaacatgacatcatgaatgagggcaagcacaaactgcccaatttaagtttgaagttataaacctaaaatattttaaaacaaaacatttctcttggtgttttgcaaaagcaatgctttcttctattgggcagaaattgcagcctgttgggatgaaggagagaatagaactaatatttattgagtagctaccatggctttctgggacatctgctaaccccttaatttttacagtaaccctaagtggtaggccagtccatctgcattttacagacaggaaatgctttcagagatattaattagatggctgtagaccacagaagaattgaaagtcaggtcttcttgacttttcagctcatgacttcattacttctgccctcctcattctgttgggagatgggtgggagtgtgccctccagataatcagaaagtcccatgttgggatgtgatttggaaatagctagtcctcaggcctgtggacgaaggctattgtagcctcaagaaagaaagagtcagcttgatattggcaaggtggttatttagtgtggcagctgcataagagcattggataggtggtatgatatgggatgggggtcagggtgagagctgctcacacctccttattatggcagggcaaaaccagaatagtcacagtgatggtgatgtagggtaggttcaagagaaagctcatgttcttctagcattgagactcacaatatttcaaaacaagtgattatttattccattactatttattttggtgatggatgttgcatttattttattttctaacagtagtacatatttggtaagagttgtttgtgacattctttatttaaatggattaaacccattttcttaatttttttaagtgtttgtcctgttatcgaagatatcttaaagtgttacagaatgggaatcatagctttaatgagtctgcatataagagagtccaaacattttttttttggagagaaggaaggtcatttcaactgtactataggaacgatagggcccatgatccatggtatggcaataagttactattttttggagaataaatcgcaaaatatgggacgtgaagactgcttggtatttacacaggagtctagttcttctgatactatatattctataagctttctcccagaaatccaaagttttatttagcttgtagccatcattgtgccacaatcttccttccatgatttatttttttcccatactgtactcttgcactgagtctttggcattgaaagggaaagagatgaattattcaactcttcttctattgagtgaaaagccaatacagaaaaaaaaatgcaacaggcaatttcatgactgacattttggagaacattggggtcatcatatgactgagaaaatgattatctcttttgaaggtcaggaaaccaatatttttttttccagtgaatctactgagggaaccaaccacctagctttttgtaaatagcactcctcagggaaatgttgcttttttcttttgcagtgtttctgctttgaatcttcatagactgtatcccatggaagcaggaatataattactgtagtgcttactttttttcatgtctctactgaagagccaccctgatttatcttttactccaaggtagtgtggaactttacaaggatttagattatattagtcattttgcttggagatctctgcacacttttcaacatcatttctaagagccttgccacactcagtaaaagagggtgaggcttcaagaatctctgtgtaccaacgcaaattaggcaatttgtaagaagtccctagtagagcagagtggagagagggctcaggatctcgtgaggcctggggcagggaggtggacatgctatgagctcctttcacagtcaacacaaagttaacacatcttggaggaaaaaccgttactgtatagtggaaggcagaaggcagggatgtctgtgcttggtgatgaagctataagtagtgagctgatttatgatggaggggtgaattgtgccatgaaagagactcccctcaattttattagccagattactgcccatacgcggggtgaggagtgagcattttaaggcatttctctctgttttcaatatatcatctctggattcactattactgggacttgtgaatatagactagggattaaaacctgagtttgcttttaaaaaactttattttattaaatgagatttctgagcaactgatttcacttagtcttatcaaactattcttactactttttcgatatgcattctgtccctcctgtgtgaaggccacaggcccatggcccccatgtcattgagatggaggtcctcaagtgatggcgggatgaatcacctctcacttgccacctgcgagaatgtctatcactgatacctctccttatgtcccgtagcagctgctaagctcccacgttattattggtgacactttctagtgttcaggagagaacaggatttactttttgaatgcctctaaattattatagcaggttcatttggaattgcatatcagaacattcttcctgtttatcaggaaaataaaccaaggtcttgaaacttgatgtctatccatagttggcccaatataattttgcatgtggtttattacattatttttctccattggctatgaactgaaggcatctcatggatatttattccacgctgaaaaggtagttagatgctgtgtggtaaagtcgagaccagtatattggaagaaaagagacactccatctaataatctttcatagtcttcacattcattgagaaggttacttgataacctttcctgcacactctctcccaaccctgacccaggaacttgcagagcacactgtgcaacagatctaataacccttgtctgcaggcaatatgcacagctgggaaagataattaaatagactctttttgagaggtctacaacatttcaacggaaggatcgagcaatccggctggcctccgactgaaaactattaccaacagacatacttcagacagattccatgatcaccatccttatgtggcacaagtgcttatggggagcttctttggcttccaaaaggccactaaaactgtcagacctaaataatactggaactgtaaagtgggaattaaaaattataattccatttaacatgtaacgttctcatcagaaaggggcctttggttttccatattgatcggttacatggtcagctgcaattgtaactcatgagacacacccagatatcatcctgcgtgattctttttgaggtttatttagggtgttagataatccgaggtaggtttcatcatgggtggcaatattacgtatagcaaatgtcatgagaagagagacaaagcctcccttttgaatgttaacatttatgcaataagtttaatgtaccgtgtaagtttacattactattatgagacttaacctaaaaaattggggtgaaatcttaaagaattatgaaattaagaaatgaaaccagagggctttcgttttaagtactgatcacttaaaccaaaaccagtttggcttatcctatgagatcgtgggtattgagaaagaggaacatttgctgctgcatccggagatgtttccttgagagcaagactagttccttttgacccagtacatcctacaggtaaatcactgcatgctgtagagatacctgttccctcccttcccccaccccctggggatctgaaaccaaatcattgctttttcatcttttacttatccttataaacaaagccacccactttctcatttttcctgatgccaagtccttctttacatgagtggaatccactcttttcaatggaaagacacctgctctgagacaggctacactgtcatgagccttggcatggctgagtgatgtagtggaaggtgcaataaatttaaactttaaaaatgcaaaatttgatggaatcatgcatcttgtgcctacagtgagtatatggtctagcaggatttacagatacatgcatgattaatttgaatacagtatagcaaaatgatctgttaaaaaacacatgaaaagatgtgcaaccttattagtcattaggaaaatgcacataaaaccaccgttcctgtgtgatacctctgtacgtctattagaatgtataaaatttaaaaagactgaacatagcaagcactggtgaggttgtagaccaactggtgctttcatgttttgctggtgagaatgtaaacattacaactactttgaaaacagtttgacagtttcttaaaaagctaaaacatccacctggcatgctatatacagatatcctactcttacgtatttaaccaagagaaataaaagcatatatccattcaaaaacttgtaaataaattgctcctagcagctttatttgtaatagccaaaaactagaaacaacccaaatgtccaatgaaaggatacatcgtatttatttataggacatatccatgcaatggaataccacttaggaatagaaagaatcaactgttcatcatacatacaaccacatggctaagtcttaaaaataattatgcttagttaagaagtcagacaaaaaggtaagagactgttaggagctgaattagcgggttaacagtggcaatgaaaaaggagaaaattatagctacctcaagatagaattgatgagctttgattatgaaatgatggtaagagagagggccatagactctgaggtctgtctctagctttggtttccctatgtggatcattatctatttggatataagaattatctgaaagatgatacttaagcatgtaagaaatgataagctacctgtttaatgatgagcttttgttacctccaagaaccccaagaagaaacatcctgtaagcagaccattcatacttgattgttaaaggaaaacaaaattccattttgtctttttcatcaacacaagtatagctggctaataaaagtgtaatattcatgagagaaaaagaaaagaacacgcacacacatacactcaacaggattcctagagtcattcccatggataagagggaaggaaaggttgagggcaaagagagaagggaaggaaacagactatgatgggatatcttagggcaaaagaatagggggctgatttggaaggcagcaaacttcatggatacttgatttatttaatgtccctgtcactctggcgtatcttaatgtgtgtggtgtgtgatttatttagtcacttgatccaaattctctaattaagtggagctcagaagatatagtgtccattgtggtcaagggcacaggttttggcttcaacagacaaataagctctctgagcatctgtcttctcatctgtacaatgggaatatcagttcctacctcttcaggttgttgtattcataaataaattgtgtacaagaaacattaggattgcttcttacccgtagtaagggctcaacaaaccttctcctccttctcctcctccttctccttcttcttcttcctcctcctcctcttcttcttccttttgcttttctccttccttcttccttcctttcttcctacctccttctcattattgttattaggtaaccacaatactatcagtaatgattggagaaagctttaatctcctagttcaccattagaaaacaagaacacattttggtggttattacccgaagtaatcataatgtcacctttttttccatctgactcattatcccaagtgatttatttatatatggagttttctgagtctttcttttacatattacaaaaaaagagtgtgatttagggacgaagcaaagaaataaaaatttagtgactttcattctgcctgtgccccaattcctattgggcataaggcaagtaatttaaatttcttagcaccttagcatcttctactcaaacagaaatgaggaacagtcacaggttactattatagctgtctaagtagaaggcacacaagttttcacactgagtataacactttatagaaagctaagtgtgttgctcaagttggtacatttctgtagatgtgacactatggcactaagaaacttaatgccacattgaaattcattgagatagctagactttaaaaataattacttgacttcactataaagtatgttcgtattgcatttactccatctagtagaaaatagaccttgtcagttcaaatccctgttgcattaatttcaccagtaatgagtctttttcatttgagtcagcagggtttttcttgcttgttttcaggctttgtggatttgaccctccatgatcaggtccaccttctagaatgtgcctggctagagatcctgatgattggtctcgtctggcgctccatggagcacccagggaagctactgtttgctcctaacttgctcttggacaggtaagtgacctggctgtagcttaggagtagcatgttctttacgatcatagttcattcatgaaactattttattcatctctcggtgaagcttcagagaactttattaggtatgtttacttaacaaaagagtgcattgggggtgatgaagcctagtcaaattcacagaaagctaagaataactttctgctagacattacctcagaagaattctattatttctaatacacacacacacacacacacacacacacacacacacacactcacactctctctctctctctctctgtcattatgaatggtaattttctaactccatcttcaacttgtatcatataaaaattataataacctctctttaattaaaatctgttgttgcttcttgtacatccataccacaatagcctattcattttcttctccaattttcccatccgtaaaatgaagaaatttgaccagagttctgaaggtcacattcaggtcgacaaattcattttcatgttcaaatatgttaccttctttaacataccattctggggttgccttggaatgtgggtcccattgttttttttttttcagtcattgcttagagtcatagaatttagatattactcaatagcagctgccactgatagagtctccaccctgcaccagctgtgatgctaaacactttacatatattatctcatttaatcatcaccggactcctaggaggcaggaatgtcatcatccatgttttaccagaaaggaaactaaatctcagagacatcctgctacttgcaaaaagaggaaagctcactaaatggtggagccagagttcaaattcaagatctttctggctccggtatgctctgttacctcctgtgctgggcacatggtcttcccactctcatgttcagtgatgcctcctttggtctgctgccatagcattctgttttccaggtaaatcttgtctttgtgggctacataacattttggatgagaaagaaccattttgttgtttcttgcaatcctattttgcctccgtgccaagcagtctaaggctgccaggctgcccacagtgcatctctgcatggtactttacttcagagcatttcactatctttctacacctgccaagtgcctggagcagagttgcagcaaaatttatttaagtactggagaattgtacaaggtgttggttattgttttgtcattttgtgttaacacagcttttgaaaaacagtggtgatacagtttaagaagcatattttgctgtctgtggaatatattttgatatcacagtttcacaaaattatcaagaatggccactagtcttgttccttagaactgtactcacaatgtattctgtcagccttatagaggatgtctttaccgtgttctttcctttccattccttgtttcctttccattttttcctatctcatttctcctctcttttcctttgctttcctctttctttctttctcctgtcctcttaatttttttgtcttatagcagtgtggttttgtaaccaagtgatatcaagtttgcaaatgaaaatcttagaccacacgtaacatttccctgcctactgcctggagtgtctaccatgtttaggtttttggacattcataactcatttgctccttgatttccatcctcatctgtatctatcttcttttttaaaatttaattcaatttttataatgttgacacaattatgcagattcatagggtacacagtgatgttttgatacatataatgtgtggtgatcttatctatcttcttgagtacacacttgcttgaggacagtcatcaaataattgcattttgaatatgtgaaggtttttgacattactgcacccaaaaaactcatattgccagtgaggtgatatggcctaggattttatcagctacagccttctctttcctttctgtacactccagtggtggctaattttctttcctctctcacagaagtatgaatgactaaaagttctcatctctattcattcctactttctaaaacttcagatcggaaatttgaattacctctagaccaggatttgtcagtctctttactattgacattttgggtcagatcattctttcattctttcttggttgaggggttgatattgtttggtgtgtcctcatccaaatctcaaattatagctcccatagttcccatgtgtcatgggagggacccggtgggaggtaactgaaacataagcaaaggtctttcccttgctcctctcatgacagtgaatttctcatgatatctaatggttttataaaggggagttcccctgcacacgctctctctcttccccgttgccatgaaagatgtgactttgctccttcttccccatgattgtgaggcttccccagtcacaaggaactgtgagtccattaaacctttttctttgtaaattacccagtctcaggtaggtctttattagcagcttgagaacagactaatacaaggggctgtcttgtgcattttaggatgtttaacagcatccctggactccaccagctagctgccagtagcaacctccacttcctccagttacgataactaacaatgtctccggacatttctacctatcttctgttgtgtcagggggtgggggaggtaaaattgcctctggttgagaatcaccactctatgctttcccaactcaatgttctataagctcctcagacacactgtactctaaactgcacactcactttatcttctgcaacaagtctattccttttcttttctgtcttggtgacatcaacactcacctagacactaaagctagaagctttaagttacccatggattctaccttctccctcaccaaattatccagttaactatcaagtcatctatgaactgcttctgaatccagacctcccctctatccccattcctctgcatggcacaggtcctggttgtctctgctgcagattccttgcttctgcaccactgactcactttcttggtcctgctactctttctttcagtccatctcccatactgctgctggagaaggctttctaaggcacagctgtgatcatgatgcttcctgactcacctttcagtggctctctcaattcttaacatggagaaaccccatctctactaaaaatacaaagttagccgggcatggtggctcatgcctgtaatcccagctacccgagaggctgaggcaggagaatcgcttgaacatgggaggcagacgttgcagtgagccaaaattgtgccattgcactccagcctggatgaaattccgtctcaaaaaaagaaaagaaaatactgtgtagacttcttatcttaataatcatgaatcactattacaagtgtctcaaacgcaaatttctgaagagtcacaggtgacccagtgagcccttgtccaggctaaaaacacctggtggctgaattctgaacttcacacattcgaatttctcttccattgcttctgagagaccctccaccattacggttccttatcagagtcatatctacctataaggctcatttcaggtgccgtctttttataaaatcttccttcaaactttctcctcttcagcctttatatatacaaaaggcttttctttcttttccttttctaagtttccattgtagttggtttgcttttctctttattattctcattccaccatattagttatgattggatgtcttcttaccttccctactagctcataaacttcttgtggtcaaaaaccagatcttgttcgtcttgtgtgatctccagtttacgaagtcttccatgatacccaacaaatatttgttaattgcactggccaaggtcacccaggtggcttgtggccaaatcagaagaatctacatcttctgatagtcatggcagctgttattcccatccaactcacttcctgtgcattgctactcatcaattccccacttattcttttaaaaacattgcataaatacatatctatgtgttttggaaagattttcttaatctataagcgcatttggcgtgtgcttatatgtctgcttatatgccaaatttgaaattccaaatttcgccatttggaatttcaaatggggaaaagcaaagactcttatctttcccataatcaaaccccttatgaagtaaaatccttaaggtctctctacaggttaaaaataattaggtgatatgatttggctgtgttcccacccaaatttcacctttaattgtaataatccccaggtgtcaagggtggggccaggtggagataattgaatcatgtgggttgttttccccatactgttagtgtggtagtgaataagtttcatgagatctgatgattttataaatgggagtccccctgcacaagctctcttgcctgctgccatgtaagatgtgactttgctcctccttgccttccgccatgattatgaggcctcctcagccatgtggaactctgagtcaattaaacctctttcttttatatattacccagtctcaagtatgtctttattagcagcatgagaacaaactaatacattaggtatatgttaatgatgaggaatgtgtataaatacatatacatttatatttaaatattaatatttacaaataacatgatattaaaaatatggtctataattttttaaattatctacctttctaatcattaacatgcactaaatattattaaatttcaatattatttaattaccatcttggtgtttgaggataactgcttttgatggcattgatagatgcattaacagtgaaacattgtgaccaacagcccatctgagattttatacttgtagaagatggcttctgagtgacagctgagaagactgtttatgtctttgccctacaggttcctaacccctttaataaaatagagctctctgatgcagatgacacatgggccttctttttgctcttgtcccatcacattgtacatagtaaacatttttagcaacaaatagtagatacttataactttaaaagctaagtggttgacagctgagaggcagatgatggtaatttcatcatttttctcatatctcaggcattgtgacactacctctgcaaggtcaactgtctccataggctgttttcatttgcgtagaaataggggggaaagatagcttgaagtcatcaggagccctgcaacccatggattaccaatgttgctaactggagcctggatttcatcttcaattgattgtaatgatgtcttgttctctcaaatctttgcaaatctaggcatttataagactatcctgtaggtcccttacaagaccatgaggatgctagaacttaccctagtcttttcttgtaattgcttaaatgttagtattggcaaatggggtttggtgattataagagtaaaaaaacctgctgccatcccacatttgtgagcagaggatacatttcctatcttgtgtccatttaaaaagaatgattgcttgattggcttcctgatgacaacccatgatatactgattctgttagtttataactttcctagtagtcatatgcttataggccaattttatccttgccatgcttagcctagtcacaatttccagttcttctctgtatcctgcagcagtgagttccaaacacttaatgctgtcatctcttcctgtgaaaaccaagaaataaaggttattataaggtataaataaagaacccagtgatttctcttggggtgtgtgtgtccatgtgtgtgtatattttacaagaggaaagttaaagatactaagaatgcctgtgaaagtaatcaggaaatggagaaaacttgttttccattctagcacctaatcctttggtgtgttttggcactagaaaacacaaaatatgtcctctgtgtctactaggaatgcctctcttcatttagtcctgcttgagtgctcatgatggaaaaatatagactgaaaacaggagcaaaagtgttcatcctactcattccttgtggggtctctttgctttcaaagagatgttagagatgttagtaaatggtgttagaagaaacaatgtaaattgcctgtttagtaagatgatccagtttctaaggaactgttttactggcgccttccatgctaacaaattctgagaaatatttgcggatttctcagtgaagccaaagcactctcttttgactcctatttactctcagagaaaaaaactattcatccatttgaaaagcagggaccaattcaacaagcagaatattccctctactaagcctttggccagagagttgttgctctagttctttccatcactcctgcatcaggaggctctgcctgcaggaaatagtattggacaacagaaagttcttttacttgtaggcataaaataggtataaattctcctccttaagagaaaaacaggttgctgcaccagaaagaacatttgcctcttctactaaatagcagactgttttccaatgataaactcattttaaatagaaaaaaaaaagtcattctctacaaacaagaacattttcattttaggttgtttattgtaaatatttcagaaaaaaaatatgcaaaaaaaaaaatgcccaaaaatcaatgcttccagtaacatatttattagctatctttttccccatgtaaaacttcaggtaaattctttgcagattttttacttggaagaatgataaaaaaaaaaaaaaaagttctgaaatgagttgaattcatccacgtgtgtttttgattcacatgaagagtaggacctccctttatattccctcttcaaattctcccctctgaaaaatgggtggtacactcaaaggaggaccgcacacattgtagtagctggggtgttgggggtggaaggagcaggttttgggggtgggaggagcggtgagtgatcctttcagcaaagtcagtcctgggcaggagacggcttcaggaatactgtcagctttactggattccaccatcgctttccaggactgtttaggccctgggcccttgaagggtttgcgtgcctcttgtctccattcatacctcaagaactttgttcatgttaattttttttcactctatcatatggaattgagtaaaaaaagaaaaaaaaaaggaagccaacacttacttaactgctttaatgtataggactctgttctgggttgtcttctaaagtacatttcattcaatgtgtgagaatacagataggaaagagttttgctagtttctattttgactgtggatccattgattctttctggttctcagcccttaattgctcagctgcagataccacttgactgactcttaaaagtctttggtttattgcccaattctgggaatatgaaactgtaagctgtttaggagaaaaactgagaccaaaagaaaggagaagtgagccaaactgccattatgactgccacttcttattgaagataaatcaaaatatccatttgactagaaatcaattgaattatgcactttaaatgggccaattcaatgatacctgaactatatctcaaaaaaggtgttaaacacaggcacacacgtacacacacatattggaattccaggaaaagtcactttgatcaacaagattatcagtcgtcaaagtgcttggaagggttctattggaataaagctaaaaaaaatcaaagtaaaatttctccttaaaaacaaaagcaattaagcagcactgtattataaaatatgctaagctgcaagtcaaaattcttaagagacttaagcctgtaagcagtaaggatccactcaatgtaaagttactccagagggaaaggcgtgagcccaaccaaagtattaatgctgtgtaggaggttaatttgactcttcttaacatttttacacaccacattatgttttattcaccatttattattaactgaatttattaaagtataatcaaaataatatttttgagagtttaaaaatattctcataatatttaagttacatatactatgcagggaccgtcaagtaattccactctgacatctgtatttattaccgccacctgtccatgatggtattagaaagatcctcatttgttttaatggatgcctctaaaatccagttttaagagggggttggccactttcaagtttgtgttagttaggattcagtttaacccagctcaacaggtatttactaagtaccagcatatccatagggcgctgtatgatactggaggacacacagaaaagagatgtgtaagaggcactcctgccctcaaggagtttactattgagtggtagtgtaatatgaataaacaaatgaatctgctcaaaagcagggcattctaagcaggccctcaccagcctctcatcattcgcatctagtgtatcttcctccatcactttctaaacgctatggattctgagtgaaaaccaatcgctggtttatgcatgtatgcatatatgaattcattcttgacattgccatgcagagtatttagtataactagacttattatccatttatcctgcctagaagcatactgtaatatatataactctaaaagcaagatcattccttatgttggttcttttgagctggcagggggaaagcagagtatgttggcaggggtctatcaaggtagatgagcccagtttgtacatctttgaaatattaccaatgccaatgtgttagtactgcttggatctcttctatgacaacagttcttattttttccttttttctgtttgtttgttttttgagacaggatcttgctctgtcacctagacaggagcgcagtggtgtgatctcggctcacttcaatttccgcctcctgggttcaagcaattcttgtgcctcagcctacagagtagttgggattacacgcatgcgccatcatgcctggctaatttttgcatttttagtagagatggggttttgccacgttggccaggctggtctggaactcctggcctcaagtgatctacccgccttggcctcccaaattgctgggattacaggtgtgagccaccacacctggcccatcagttcttaatttgatgaatggatagaggtttggcttcaaataaatggagttagtctgtcaatatctgtttcttttaaaatttgcaattgtttttatttttagtgtcatgctatgtgcccttaatgatctagaattaagttctaatctctaccctggtataattgatttctccctgtggactcctaatataagaagaaagatgaagtttttcttttaatgcttttagagatcttcattaagtcatttaatattcttatttgctatttcccagtgtgatggttaagactgagtgtcaacttgattggattgaaggatacaaagtattaatcctgggtgtgtctgtgagggtgttaccaaaggagattaatatttgagtcagtgggctgtggaaggcacacccacccttaatctggtgggcacgatctagtcagctgccagcgaatataaggcaggcagaaaaacgtgaaaggggaaactggcctagcctcccagcctacatctttctaccatgctgaatgcttcctgcccttgagcattggactccaaaatattcagttttgggactcggactggctctccttgctgctcagcttgcagacagtctattgtgggaccttccgatcatgtaagttaatgcttaataaactcccctttatatatatcctattagttctgtccctctagagaaccctgactaatacacccagtgtgttcttttatcaaatagaaaggagatatagaaaacacactgtccatgtctttgattgttacaccacagcagagaatcaatttcttaacctgcttacttatttaccattctccaatggtgccaattctgagatccatcatgactttatcattagaaaaggggatgtaacaaacatgatgacatgttacgggaatactgcttactgcatgatatggtttggctgtgtcctcacccaaatctcatcctgaattttagcctcccatacttcccacgtgttgtgggagggacccggtgggaggtaattgactcatgggggtggtttctcccatactcttctcctggtagtgaataagtctcacaagatctgatggttttataaggggttttccctttcacttggctctcattctctcttgcctgctgccatgcaagacatccctttgctcctccttcatcttctgccatgattgtgaggcctccccagccatgtggaactgtaagtcctttaaacctcttttctttataaattgcccagtctcatgtatgtctttatcagcagcatgaaaacggactaatacactgcatgctcagtatactcaggcactctggaaactaggtttctacttcggacccctgagagaaaagggttatgtatctccaagtgtggtcatgacaagcatcactactgtgtgcagttgggcctgtggattgagccaccttagcctctgaggaaagcagaacctgagagcatgcttaattcagagtgtgtgtgacttggagtgtggaaaggaagatttccagatttgcggtattggcgactgaaaggatggcaatgctattgatggagattaggaagacaggagagaggtagatgttgagcaactccgaggagtttttcctcatacatgttgggtttaaagtgcagggaagatatcctgaaggttattccaggcagaaatttggagctcagaagagacatcagagctgaagataaaaaatttgagagccatctccgtagctaaaagtgtggaacgaatgtgatgactagacaagataatagagaaaaggtatccaaaggcctgaggtcaagacctcttaaaaggctgacttttcagggttttaggtagaaaaagagtcccagcctggggttaaggcagttttttgagaagtagaggtacaaagttccttgttccaaaggaagggtgtctttcaaaagaaaaaggatgggccgggtgcagtggcttacgcatgtaatctcagcactttgggaggccgaggctggcagatcacctgaggttgggagttcgagaccaacctgaccaacatggagaaaccctgtctctactaaaaataaaaattaaaaattagccgggcttggtggtgcatgcctgtaatcccagctactcaggaggctgaggcaggagaatcacttgaacctgggaggcagaggttgcagtgagccaagttctcaccattgcactccagcctgggcaacaagagtgaaactctgtctcaaaaaaaaaaaaaagagagaaaaagaaaaaggatggtgaattgggccaaataccagagagatggacaggagtaagaagaaaaagactaaagatttgttcatcaggagctcattgtttctaaagggagcatttttagtaaagaggaaggaggaataaaatgcagtataatatgttaaatctaagtataatttataaaagagaaaatgggggtggaatattacaaaaaaggaactataaaccagctctttgaggtatttgtcagtgaggaaaacagtggggctctagttcttgatagcaacagcatcaaagggaactttttaaactaaaatattatgaatttttcaaactgaaataatgagagaataatacaaagaaatctcatctgcccataatccaaattcagtagttattaaaattttgccccattgcttaatccattaatctcatttcattttgtcctttttctttgtttatttttggctaaaacattttaaagacaaatcctaaatatcatacatcagtaggcatttacaaaaaaatttcttgataatcacaatgccattctcataccaaataaacttataataattctgtgatatcatctaaaaaacagttcttttctacatcaaaaatgtctgtttatagttgatttattcaatttagagtccaaacaagttccatatattagacattaggtcattaatgtctgtctatttgaatttataacaatttccacttaatttattttctccagcttctgtggagactaggtaagttgttttgtagctgtctggatatatctgattgcttccttgcagtgtcatttaacttgttcctctatcctcagtgtttctgcacatggaagttagcctcatagcaggggttggcatactttagcctgcttaccaaatacgactcccttacatttttgtaaataaaatgttactggaacactgtcacatatgttggggtcatagaaagagtttccgtgtccccaagttataattgcattcacttatattttcttctagtaatttttacccttacatattaggggtcaatttggaatttctcttcatatacagtatgcaataaagaatggcttttatatttttccaaatgtatattcagttgtctcaacaccatttattaaaaagtcagtatttctcaagtgatttgagatctacccttaattacacagtaaatttctctgtagtcttgtctttttctaatatgttaattctgtaccaagatttgttcatctgttaatggatcaatatcacatagctttgtttatagaaggtgcacattgttttaattctggccatgctatcccaccaaatattgccctttgatttttcagagttttactgtggattcttccttgtttctttttctatgtgacctttagaattaacttgtttaattctataagtaaatttattgataattttattgaaattatgtaaaatataaattggcttaggaagtactgatatctccatgacattaagtcttcatatctaagaccaaggggtgccttttcatttgttaaatattctttgtgtctttcagaagtgttttcaagtatccttatgtgtattttgcacaaatttttatatttgtgcctattggatgccacgtgcagggttaaaaaatattatacctattttatatagatatatatgtatataaaaatatatattatatatagttataatacataaatatattttaatatattatataatatatacatgtattgtatttatatatgtatttatatgtgtatctataaatatacatatgtatgtatctataaatatacatatatgtgtacatatacacatatatacacattatatgtatgtttatacacatataaatacatatataaatatactagaaagtccatggggtttcctagtatacaatcatattgtctgcaaatagagattgttataccttttcctttctattccaaagtgtctaaaagattttttcttagctagtggcattggatgacacctataatgtcttctaaaaatagtagcagtcataggcaccatttccttattcttgaatattcattcatgttacaaagtttataggaatttctgaattattaagtacttttaataggaatgaaggttattgtcattattgcatcaaaattcataagaaagtttggtgtcaaatttgtgctttgtgtgtagtcttcatcacgcttttttttttttttttaaccagtgttaaacatccattacaaaaatagtttggaagtttttctttttttttttcctatgtcctggaaggtgtaagtagaattggaattatttgatctttaagatgtaaaatattggtagaattctacctttgaaagcacctggacatggtgacttcttaataggtgagctctctggaaactttatttcttctgtagtaattggtctccttagactttctattccttctggagtcagatattgtatatcaaatcttctgttaaagttatccatttcttcttggtattccaatttttcacattgagttggacaaatgatttctgatgatgtttaaaaaatttctctggtttgatggttactttgaccgtataatttattttgtgtatttatgcttcttttagaaacttaggtcagctagtggttcctctattttgttgatttttttcctcaaagaactagcttaagtttattttattagttctactagttttctgctttctaactcattaagttatgcctttagctttattaaatccttcattctgctatcagttaatgttttagttcattttctagctttttgagttgatacttaatttattttcatttcatgatataggtaactgatgctcagaattttctcaaagcatcagttttcgctgggccccatagattctaatatatcttactttcattattattatttcctaaaaattcagcaatttcatgttttattttgtctctcattcaagagttgtttaatagacagtttaatttccaggttggatgggcattttgttttgttttttgttttactgtttataaatacttttggccttgggatcagagaatactgcttgtattacaattattactgaatatttttgtggtctaatataatttcagctttcaaaaatgttccatgtatacttgaaatgaaggtttatttacccttataaagatagaaggtaaaatattagctatgcccatgtctatttatcttcttataatttttgcttaatgaaaactaatgatccattatctgctgcataagtatttatgtttgctttctctttattatgccttatggcttttgtgttaaaaagctattgatttatttaatattttggaaggattgaattttaccctatctaatatcaagatcatgactcttgattcctttttgttttcacttgtttaatatatctttcttctatctttattttaaacacaagaagagctttgctttcagtttctattttacatagtctacaatcggattttacttattagtcaatctgagaatacttttaatagatgagttacacaaatacatatttattgataccaacacagtttaattcaagatctgttctattattttatatttattatatattaaattgtcttctttatttactatttattgatttattgaatttattttgctttcaggtattttgtatttttgttctggttgttagatttatgcatacttagtcaactcttcctttataaagcattcattttctactatgagcagtagtaaaattagctagtaacttaattcctgagcactctccagtcctagtcactagtaataacgcagtgttaaactttgtaatattaattatacttaagcctctattacttggtttgtcaaaatcaaatgatatcaatttacttccagcacatacctatgaggtaattgtaagctaataataacttccatggctattcttttctctttttttttttttgaggtggagtttcgctcttgttgcccaggttggagtgcaatggcacgatctcggctcactgcaacttctgcctcccgggttccagcgattctcctgcctcagcctcccaagtacctgggattacaggcatcagccaccccacctggctaattttgtatttttagtagagacagggtttccccatgttggccaggctggtcacgaattcctgacctcaagtgatccaccccatcagtctcccacagtgctgggattacaggtgtaagccaccgcacccagcctctcatcttatttttattacttatatttttctacattattagaagttataatacttatatgcacatttctttagccccaaccccattttttgatattagctctattattaagatatttaatgtccaccttcagattatatgctgatgattctctaatcgtttttggttgtctggagcttttttactgtttattttcaggaagagctcatgataactcttttttctttggtttaaaaatgtttataattatttttctctggactttatgctgagaaatttggctgcatacaaaatctctggcttacattttttctcaagtatttttaagtgattgcttcattattttgtagtataaaatgttgctcacaagaagctggatgccagtctgattttctttccctcattagtgatttggactttttgtctgaatgttgaatttttaaatataaacataaattgcaatacttttattaagatatgtctctgcattgaacattttaggtccgttttcctaggtacatagaatgtcttttgaatatgtagactcaaatcagacttcttgattctcttgatttatagttttaaatatttgtttgggggcgggtgcggtggctcatgcctgtaatcccagcactttgggaggccgaggcgggtagatcataaggttagcagattgagaccatcctggataacatggtgaaaccccgtctctactaaaaatacaaaaaatatagccaggtgtggtggcaggcacctgtagtcccagctactcgggaggctgaggcaggagaatggcctgaatccgggaggcagagcttgcagtgagccaagatcacgccattgcactccagccttggcgacagagtgagactttgtctcaaaaaaaaataaatagggggcggttccaagatggcagaataggaacagctccagtctgcagctcccagcatgagtgatgcagaagacaaatgatttttgcatttccaaatgaggtaccaggttcatctcactggggactattggacagtgggtgcaggacagtgggtgcagcgcaccaagcatgagccgaagcagagcgaggcatcgcctcacctgggaagtgcaaggggtcagggaattccctttcctagccaaggaaaggggtgacagacggcacctggaaaatcgggtcactcccaccctaatactgggcttttccgatggtcttagcaaacggcacaccaggagattatatcctgtgcctggctcagagggtcctacacccacagagcctcgctcattgctagcacagcagtctgagatcaaactgcaaggtgcaagcgaggctaggggacgggcgcctgccattgctgaggcttgagtaggtaaacaaagtggctgggaagctggaactgggtggagcccaccgcagctcaaggaggcctgcctgtctctgtagactccacctctgggggcagggcatagccaaacagaaggcagcagaaacctctgcagactgaaatgtccctgtctgacagctttgaagacagtagtggttctcccagcatgcagcttgagatctgagaacgggcagactgcctcctcaagtgggtccctgacccccgagtagcctaactgggcacaccccagtaggggcagactgacacctcacatggccgggtactcctctgagacaaaacctccagaggaacgatcaggcagcaacatttgctgttcaccaatatccgctgttctgcagcctccgctgctgatacccaggcaaacagggtctggagtggacctccagcaaactctgacagacctgcagctgagggtcctgactgttagaaggaaaactaacaaacagaaaggacatccacaccaaaatcccatctgtacgtcaccatcatcaaagaccaaaggtagataaatccacaaagatggggaaaaaacagagtagaaaaacagaaagttctaaaaatcagagcacctctcctcctccaaaggaacgcagctcctcaccagcaacggaacaaagctggatggagaatgactttgactaattgagaaaagaaggcttcagacgatgaaaattttctgaactaaaggaggaagttcgaacccacggcaaagaagttaaaaaccttgaaaaaagattagacgaatggctacctagaataaccaatgcacagaagtccttaaaggacctgatggagctgacaaccaaggcacaagaactatgtgacgaatgcacaagcttcagtagctgattcaatcaactggaagaaaggttatcagtgatggaagatcaaatgaatgaaatgaagtgagaagagaagtttagagaaagaagaataaaaagaaatgaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcacattcaggaaatacagagaacaccacaaagatactccttgagaagagcaactccaagacacataattgacagattcaccaaagttgaaatgaaggaaaaaatgttaagggcagccagagagaaagattgggttacccacaaagggaagcccatcagactaacagcggatctcttggcagaaactctacaagccagaagagagtgggggccgatattacacattcttaaagaaaagaattttcaacccagaatctcatatccagccaaactaagcttcataagtgaaggagaaataaaatactttacagacaagcaaatgctgagagattttgtcaccaccaggcctgccctacaagagctcctgaaggaagcactaaacacggaaaggaacaactagtaccagccactgcaaaaacatgcaaattggaaagaccatcgaggctaggaagaaactgcaactaacaagcaaaataagcagctaacatcataatgacaggatcaaattcacacataacaatattaaccttaaatgtaaatgggctaaatgcttcaattaaaagacacagactggcaaattggataaagagtcaagacccatcagcgtgctgtattcaggaaacccatctcacgtgcagagacacacataggctcaaaataaagggatggaggaaaatctaccaagcaaatggaaaacaaaaaaaggcaggggttgcaatcctagtctctgttaaaacagactttaaaccaacaaagatcaaaagagacaaagaaggccattacataatagtaaagggatcaattcaacaagaagagctaactatcctaaatatatatgcacccaatacaggagcacccagattcataaagcaagtccttagtgacctacaaagagacttagactcccacacaataataatgggagactttaacatcccactgtcaacattagacagatcaacgagacagaaaattaacaaggatatccaggaactgaactcagctctgcaccaagcagacctaatagacatctacagaactctccaccccaaatcaacagattatacattcttctcagcaccacgccggacttaatccaaaattgaccacatagttggaagtaaaacactcctcagcaaatgtaaaagaacagaaattataacaaactatctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaactttatagcactaaatgcccgcaagagaaagcaggaaagatctaaaattgacaccctaacatcacaattaaaagaactagagaagcaagagcaaacacgttcaaaagctagcagaagacaagaaataactaagatcagagcagaactgaaggagatagagacacaaaaaacccttcaaaaaatcaatgaatctaggagctggttttttgaaaagatcaataaaactgatagactgctagcatgactaataaagaagaaaagagagaagaatcaaatagatgcaataaaaaatgataaaggggatatcaccactgatcccacagaaatacaaactaccatcagagaatactataaacacctctacacaaataaactagaacatctagaagaaatggataaattcctcgacacatacaccctcccaagactaaaccaggaagaagctgaatctctgaatagaccaataataggctctgaagttgaggcaataattaatagcttaccaatcaaaaaaaagtccaggaccagacggattcacagctgaattctaccagaggtacaaggaggagctggtaccattccttcggaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctgagtaaaatactggcaaaccgaatccagcagcacatcaaaaagcttatccaccatggtcaagtgggcttcatccctgggatgcaaggctggttcaacatatgcaagtcaataaacataatccagcatataaacagaaccaatgacaaaaaccacatgattatctcaatagatgcagaaaaggcctttgacaaaattcaacaacccttcatgctaaaaactctcaataaattaggtattgatgggacctatctcaaaataataagagctatctatgacaaacccacagccaatatcatactgaatggacaaaacctgggagcattccctttgaaaactggcacaagacagggatgccctctctcaccactcctattcaacatagtgttggaagttctggttagggcaatcaggcaggagaaggaaataaagggtattcaattaggaaaagaggaagtcaaattgtccctgtttgcagatgacatgattgcatatctagaaaactccatcgtctcagcgcaaaatctccttaagctgataagcagcttcagcaaagtctcaggatacaaaatcaatgtgcaaaaatcacaggcattcttatacaccaataacagacaaacagagagccaaatcatgagtgaacttccattcacaattgcttcaaaggaataaaatacctaagaatccaacttacaagggatgtgaaggacctcttcaaggagaactacaaaccactgctcaacaaaataaaagaagatacaaacaaatgcaagaacattccatgcttatgggtaggaagaatcaatatcatgaaaatggccatactgcccaaggtaatttatagattcaatgctatccccatcaagctaccaatgactttcttcacagaattggaaaaaactactttaaagttcatatggaaccaaaaaagagcccgcattgccaagtcaatcataagccaaaagaacaaagctggaggcatcatgctacctgacttcaaactatactacaaggccacagtaacgaaaacagcatggtactggtaccaaaacagagatatagaccaatggaacagaacagagccctcagaaataatgccatgtatctacaactgtctgatctttgacaaacctgagaaaaacaagaaatggggaaaggattccctatttaataaatggtgctgggaaaactggctagccatatgtagaaagctgaaactggatcccttccttacaccttatacaaaaattaattcaagatggattaaagacttaaatgttagatcaaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagagaaactaccatcagagtgaacaggcaacctacagaatgggagaaaatctttgcaatctactcatttgacaaagggctaatatccagaatctacaaagaactcaaacaaatttacaagaaaaaaacaaacaacaccatcaacaaatgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgattattaagaagtcagggaaaaacaggtgctggagaggatgtggagaaataggaagacttttacactgttggtgggactgtaaactagttcaaccattgtggaattcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccaacaatgatctggattaagaaaatgtggcacatatataccatggaatactatgcagccataaaaaaggatgagttcatgtcctttgtaaggacatggatgaaactggaaaccatcattgtgagcgaactatcacaaggacaaaaaaccaaacaccacatgttctcactcataggtgggagttgaacaatgagaacacgtggacacaggaaggggaacatcacacaccggggccttttgtgtggttggggaggggggagggatgcattaggagatacacctaatgtaaatgacgagttaatgggtgcagcacaccaacatggcacatgtatgcatatgtaacaaacctgcccattgtgcacatgtaccctaaaacttaaagtacaataaaaataaataaataaataaataaatactagtttggctgcattgctttgattttcttctttaggggcctgttcatacatacaaaggataccatttacctgtcttctatatgactttctcttaaatcctttcattcttttgttttaatttttatcttcacatcctttatttctgtcactgtgctgtccatagagtttgtctgctgtgtgtccttataattaagtctatgttctgaatgtttttccttttttagaaattcagttctaaagtgtttaatttctcgtatttttttttctgttgcctcaccatatcatttctgagttttctgtttctgaaatgtgcaactaactctttccaagcattgaccagattcttcagtctttttaattcattctgaaataactgggctacagtttcatctgctttgtggacagaagtgccacaaagagccgaattgtcagtgcagacccacatgaatcatagatcttaacgaggtttttactaacgactagcaaaggatacaagctaaaaatgggtacaagcaaacacagcatcattcatcactgtaaagactctgaactatcacatggaacttcaaaaggattcttcttctttgctgcaatgtgttttgatttttggagtgatagatgtttgctaactacgcacgtgacaaaaatttgcttagaggaagccatgttagttttgatgctactcaactttgtattttgttagtcatgagatagaaagcctgtgagattacatgcccttcttttagcagctgcatcccataaaattaaaaattccagttttttttaaaccatgaacaatttagtcagacttaatatatcctatttaaaacattcttagataagaacttcctttgttattttgctaatatacaatcccaccaaatgtctacaagaagggctagttaatcaatataccaaagatcaaatctatttatatgaaccacaaatacaaaacataattatacatatataattttatataatttaatttataattatatacattttatagcagcaatcaaaactatcatgtattttgggatgaatttaataaagaaatagcaggagctctgtagaaacaagtatgaacttctattggaagacagtaatatcataaaacattaaaaagaaagctataccatgtttatggttaggaagattcactattgaaaatacatcaattcttgacaaatcggtctataaattcagtgcgtgtccaatcaatatatttagctcatttaaaatgtatatggaaaaggctaagtaccaaagataatcaaatgctcttggaagatgaaaattaaagttgagagatggggtaaaaaactataattcagttctaaagtcataaagctataataattaatacagtatggcattggcatagaaataagcacattgactaaataaatagaaaatacagttcagaaaccaaactctacatttatgaaaaactgacctatatcagaacgagcattgagactacaggagaacagaggaactagtaagttaatggtcctgacacaattgatatctacatagaaaaaaaaacttaatccttctttactctatgtaaaaacaataattccagatgaatgtaggacttaatggagagccaaaactaaaacttttataggaaaacatagaaaaatacctatctcagggtcgggaattaggtcttcaacatggcaccaaaagtactaaccataaaagaaacattaataaagtcaacctttttaaaatcaacaactttaattaaaaaaccagggccaggcacggtggctcacgcctgtaatcccaggaggccaaggcaggcagatcacgaggtcaggagatcgagaccagcctggccaacatggcaaaacctcgtctctactaaaaatataaaaattagctgggcgtggtggcgggtgcctgtagtcccagctacttgggaggctgaggcaggagaatggtgtgaacctgggaggcggagcttgcagtgagctgaaatcgtgccactgcactccagcctgggcaacagtgcgagactccatctcaaaaaacaaaaacaaaaacaaaatcaaaacaaaaaacaaaacacaggttgctggaaaaatggttacttatttttattatgctttataaaatatacagttatattatcaaacttcttttgtaagaatcaaatattatgctgagaatatggcaagaaaaaagaaaacaacctccaccactcataatggcattccctttacccaccatcaactaagtcaggaacctgcgtcactttcaagttttctgaaatgtggactgaaaatacttgtggagggccctcacagatgcatttagaaatggtatgttctggaaaatggaactgaaatgttttagcgagagtcatgggcccaaaccttgaaatagaggttggtggagttttctatagtatgtaattacaacacaataagactcaaaagcatttcaataaagtgtggatggaagacaagatactgcttcaagggcttcattagctttctgcagactggagctctccaaggcatggggaggaaccctgtttacctttggttcagaatcagttttaaccatcattgagggctaggtcagagtgcagcattaagtccttgggaatacactgggtggggaaagaaaagagagcaatgtttttctaaaagcccagaaatgggcttactgtgtttaccagttgtttccaggataatgtattgcagtgccaattgctgatgagatggtaggattatacttcagtccctgctttacatttatttcttaaagaagcttctggtaaattagagcaatagcatcggcttagtttagtgttgttctgttggactaaggatatcagttctatccgtatggtcgggcctaaagcctgggaaatatttaatgaagggagagagggggagagagtgagcatgcaaaagagagagagaaaaacaaataacaaaacaaaaaccaagacatttccctttatagtaagaatgatgaggaaaacatgtttagccatacaagatatcaagataatctcttatttctttcttgaaaatgcaagtacaaatgcctgcaaagataaaatatcctctggatggagtggaaaggttcaccaggcctctgaaatcacgtgaatgatgttgcgctttgctgttaatgaagctcggtgcatttttcatttcagtttctactaagcatttatgagctattacccttcccttccctaaactgcgttgttttttaaaaagccttagaggcattccttctagaaaataaaggtaagtgttaagtggtgataatttggtaataggtgtcatgcttgtggttcataatgtgttaccctacacattttctcaattatccctagaacagctttttgaggatatgaagttagaccttacaaagcacatctttctgctggaaaaatgaggtttatagtggttaagtttagttgcttatgatcacaaggctagagagtggccggaatcaagactcttcaccctgatttcagtgctttttcactccaccattaatatttattgttgataaataatatcaacactttcctaggtgtattagggtcatctagagggacaggactaataggatagatgtatatatgaaaaggagtttattaaggagtattgactcacaccatcacaaggtgacgtcccacaataggccatctgcaagctgaggggcaaggaagccagtctgagtcccaaaacctcaaaaatagggaagctgacagtgcagccttcagtctgtggccaaaggcccaagagcccctggcaaaccactagtgtaggtccaagagtccaaaagctaaaggattggagtccaatgtttgagggcaggaagcatccgtcatgggagaaagatggaagccagaagacagccagtctagtccttccacgttcctctgcctgcttttatcctagccacgctggcatgatgatgacatggtgcccgcccagattgaggatgggtctccatcttccagttcactgacacaaatgttaatcttctttggtaataccctcacagacacacccaaggacagcactttgcatccttcaatacaatcaagttggcactcagtaataaccatcacaagtccacaccttgtcaacttgatcccacatacatctccttaaatcatacataatctccaaatacagacaataatgtcataattacactgaacataatacaactatcgttcatacaaccagaaatgcaccaattcccaaaccaaatgttattacataaagttaacaacacttaaatgctgatatgaagtcaataaatactttttttttttaaaagatggagtcttgctttgttgcccaggctggaatgcagtggtgcgatattggctcactgcaacctccgcctcctgggttcaagcaattctctgcctcagcctcccgagtagctgggattacaggcacccaccgccacacctggctaatttttgtatttttagtaaagacggggttttgccatcctggccaggctggtcttgaactcctgacctcgtgatccacccacctcggcctcccaaagtggtggatcccaaagtgatccacccaccttgacctcccaggttgtaagccactaaatcttatgtcacatgatacaggaaaaagaaaggaagtaaaatgaagatattgtcttagtacaagtgtatacaggcagaaagatgttcttaacaaaataaggaggaaatactcatgacaattacagtaacctggttgctgcaactcatcacatggtcgtagctgttattgatgactaccttcttctacaacccattctgttttccctttgcctctagcaagtacctcagcaggtcatggttctttacctggtggagtgtcccaaaccttcattcctgaagggtctgggccatttgtagtcctgcctggatcgagttgttgtcattttttattgaccttaatcacagggcatggtaatactaagagacaccctaaggaatttcctgtattccacacatgttcttccttaccttcattatggagtagtagactgagttcatcttgataggctaagtcagtcaccccagccaacactaactcctttcttagcctgttgacttagaggtaggaggagcccgagattgcaatcttaatttccagtttaatgaaatcattattgtgtctcctggtggcaacattcatcgccctggaactgagacttctaggccagcagaacgtaatgctgtggaacaagaagcacaaattttactagcgggtctctaggggtgatggtgagtggtgccacttccatttccaccccttgattcctggacccatgaatcctggctatgggagaaacagtaccaaatactggacactgatccggagcatacacagccttctggaaaactttgccccagccctgcaaagtattgtcgcctagttggcattgtaattgtgacttcaaaaggccattccaccgttctatcaatccggctgcttcaggatgatggggaacagggtaagaccagtgaattccatgagcatgagcccactgctgcacttctttagccataaagtgagtgccttgttcagaggcaatgctgtgtgtaatgccatgacagtgggtaaagcattccataagtccatggatggtagtcttggcagaagcattgcctgcaggataggcaaacccatatctagagtaagtgcccattccagtgaagacaaaccactgttctttctgtgatggaagaggttcagtataatcaacctgccaccaagtagctggctgatcaccccgaggaatggtgccatatcgcggcctcagtgtttgtctctgctgctggcaaattgggcactcagttgtggctgtagccaggtcagccttggtacgtggaagtccatgttgctgagcccgtgcgtaacctccatccctgccaccacagccactttgttcatgggcctattgggcgatgacaatggtggctggggaaagaggctgagtggtatccacagaacgagtcatccaatccacttgattattaaaatcctcctctgctgaggtcatcttttggtgagcactcacatgagatacaaatatcttcacagtttttgaccactcagagaggtccatccatccacatacctcttccccaaatttcattgtcatcagttttccaatcatgcttctttcaagtccctgaccatccagccaaaccattggctacctcccatgaatcagtatataatcacacatcttgccatttctccttctaagcaaagtgcacagccaggggcactgctcaaagttctgtgcattgggaagatttcccttcactgctgcccttcagggatgtcctagaaaggggctgtagtgctgcagctgtccacttttgggtggtgactgcatcatgcagagccatctgtaaaccaggcccttgtcttctcttcctctgtcagcttatcatagggaactccccatgaggccatcagtgcaggctgggggagagaaggcagggtggcaggagtggggaccatgggcatttgagctacttcctcatgtaaagtacttgttccctcaggacttgcttgagcctgatcatgtatataccacttccatttgatgatggaatgctgctgtgcacaacccactttatggctagatgggtcaaaaagcatctagttcatgataggcaatttaggtagcttggtgatttgatgacctgtagtcaaacatacagtttctaccaaagcacagtaacaggccaagagttgtctctcacaaggagagtagttatctgcaggagatgcagggccttgctccaaattcctagaggcctcccctgtgattgacctataggggcctgccaagggctccaaacaacatccctatctgccattgacacttcaagcaccattggatctgccaggtcatatggcccaagtggcagagcagcttgccaagcattctggacctgttgcagagccttctcttctggatcccactcaaaactggaagcctttcaggtcacttgataaatgggctggagtaacacacccaaatgaggaatgtgttgcctccaaaatccaaataggcctgctaggcattgtgcctctttcttagttgtaggaggggccaaaggcagcaacttatccttcatcttagaaggaatatcttgacagaccccacaccactggacccctagaagttttactgaggtagaagttccctaaattttagtcaattttatttcccaacctctggcacacaagtgtctcaccaataaatccagtatgtttgctacttcttgctcattggatccaatcagcataatgtcatgaatataatggaccagtgtgatatcttgtggaagagaaaaactatcaagatctctccaacaagattatgacacaaagctggagaatcgatatacccctgaggtaggacagtaaaggtatattgctggccttgccagctgaaggcaaattgcttctgctgggccttatggacaggaatggagaaaaagccatttgccaaatcaatggttgcataccaggtaccaggagatgtgttaatttgctcaagtaatgaacccatatctggtccagcagctgcaattggagtcaccgcttagttaagcttacaataatccactgtcattttacaagatccatctgtcttctgcacaggccaaacaggaaagttgaacggggatgtggtgggaatcgccacccctgcatctttgaagtccttgatggtggcactaacttcctccagggatgcaatgttgtgtttgatttactatttttctaggtagaggcagctgtaatggcttccatttggcctttcccaccataatagccctcaccctaccagtcagggagccaatgtgggggttctgccagctgctaaatatgtctatgccaattatgcattctggcactagggaaatgaccacaggatgagtctgggacccaccagccccactgtaagttggacctgagctaaaattccattaattaactgatctccaaaagcccctactttaactggaggaccacgtgatgttttgggtcccctggaatcaacgtcagctcagagccagtgtccagttgtccctgaaatgtctgattatttccctttccccagtgcacagttaccctggtaaaaggccagaggtctcctgggggaaggatgggagaaagagtcactgcataaattgtcagcaatgtagtggggtccttcctcaaggggacccagcctccccttcattcaaggggttctgggtctataaactggttcaagtctgcaaattgattgaggggccgtgattctttgtataatttttaatttaaattagtcttttgtctacttgacctggaagttttctgcttatataaattaagcaagaatgcagtaggcctcttgtcaatttcactttttaggaacactgagattaagtagccaatgccagagctctacacaagtcagactattctgattgttgccttgcctccgctgacctttacggtaattgcacccaccttgccttgatgcttgagtgccaccacttggcccatgccacctcaggatccaattattaccattgtatttaaattttgtagttgaatgactgtggttcccactataatatctagcatgcagagaagagcaatcacagagctcttcaaggatgcagctgctgccctcacaaatctatttcacaatgtgctggtcaaaggtatatcttctgtactctcccagctgggatgagtaggactaaagtgacgaattcactccaccatcccaatctccataagcctttggatcccttcctctacattaaaccaagggagatcaggcatttccagctcactcacagtgggccaccttttgatctatatttcagctaaccaagcaaataaactattagaaccttttttaactctccaagctgcaacattaaatgcagaattcctgcttagtgggcccaaatcaatcaattcagcctgatccaactttatgttccttctaccattagcccacacccttaatatccattcccatgcctgttctccagatttctgcttatataaattagaaaactcaagcagttcttttggagtgtagcgcacctccttgtgggtcacattctgaacctcatctctaaggggcctgccgggactttagtctagttctataactataagcaaacaggggtattgagggtgggtccttaggagaatcaacatcgtctttcctggcaactgcctcaagggaggtcatcgctgatgccttaggcagtgcagggttaaactcctcagacaaaggtgaaaagcctgatggcagcgcaggtggaggaggggatgttgcctcccctctgttgcctgtttcctctggtaaaaaagattcatcagaatttagaagctcagtgcccccagccttatcagggtcctcccgcatggccccattccaagttgcagggtaccattctttttcaatcaatgctgtcactttaacagtaaacacctggcaaggctgtgcacgtacctttcgttgcaggtcagccactcacatgataagagcttgtgtctgattttccgcaatttcagctctttctctacaggagataagactcgaacccagggcaatcttagaagatttgaggctcagaatgtggttctggagctgggagatagaatccctgagttcatcatttttttgttttcatcactttgattagtgaacttaggagcaaccaactagcttcattatattccttggttctccacatatggttaaaggtattaggtataaagtcactaaactccttgcctctcatgagcagtgaatcaggagtatcagatgcatttattttgcataactctctacacagttcacagcaaggactatcagtgttctccacactattagaagtagagtccctagcattttggcgtctaatcatatttagcagccaactccagaaaccccaaaaccatctaaagaaatccatccgtaaaattctgttcctctagaaccactcctggtaccaaaatctgtattagtcaggattcgctagagggacaggactcacaggtgagatgtatatataaaaggcagtttattaaggagaattgactcacacaatcacaaggtgaagtcccacaatagtctgcaagctgaggagcaaggaagccagtccaagtcccaaaacctcaaaactagggaagccgacagtgcggccttcagtctggctgacagcctgagggcccctggcaaaccactggtgtaggtctaagagttcaaaagctgaagaacttgtagtccaatgttcgaggccaggaagcatccagcacaggagaaagatggaagccggaagacttagccagtctagtccttccgtgttcctctgcctgtttttgtcctagccatgctggcagctgattagatggtgcccacccagattgaggatgggtctccatcttccagtccactgactcaaatgttaatctcctttgacaacaccctcacagactcactcaggaacaatactttgcatccttcaattcaatcacattgacactcagtattaaccatcaccctaggctttagggatatagggaaaaacatgactcattgctgttatctgagagtacataatctattggaagaaaggaaaacagttacatgtaaggcttatatcagtataaattagataactgccaagtgagagaggtagaggtagcaagtgctgtctgtgggtgcatgttaactcagtcttaatcttggaagaagtggcagtgtggaatggtacatggagaagcagaagggacaattactgtgagcagatgaatggctcactacaggggcatgggaagaagatgcaagagcagtggaatctttaattgacgaacctggtaccaagctgccaagtcttagtctcaggactggcaccgtgcacttggccattgaaaagactttggaacctgtggagtgaagagttgtaggaattttcaaagcctcagtgtaggaacaatgtgagaatcaaccagggcatggtactccacactgtgttcagatccactggtgttaggggagtcccagagaggcctcttagagggttgaggaggatgggatcaggcatagcagagactagggacacgaggctctgcggccagactgcaggtctgctaccaactacagtgtgattttgcctagtcacataatctctgtgggcctcagttttttgttttttgtttttttctattacaacagtacctttctcgtggagttgtagtgattagatatctagtaccaagactatgcttgttagcactgagtaagaactcaatgaaggttagctttcattggtactatattactattgttagtgttggtggtggagctgaatcgcctaacctatgaggttggtgctgaaatgaagaaaagaataacagtgttttaagaagtttggtcactagaagtggagcttagtaattaaagaaaaagagtgaacacttttaccttcttgtggaagttagtaagtctacaaaatgttaattctgcatttgaatgatcatttgggagactcttattgtcctatttgcactgaaaaagtcactgaatcattattttagaactggaataacgcctgagatctaggccagcactttgcaagttgtgctctatgggacttttcatggaagtggctgaggagttgccttgaaggaaggcagagggagtgggtcttgggacacccttccagttataaaacaggacgttgattctgttttgtagttgcagcatcacatataatttcatttattaagaggatcccacttctaaaaataagttgaaaaccagtgatttaatccagcctctctgtttgcatatgaggaaatggaattccggaaaggttaggtgatttgtccaaggttgcagactagactatttattaatagagtagggtcaggaacaaaagcctgctccttgctggtccagcgcctgttactagttacataatgaatgctacctattgctgcacagtgccaaatcattgcacttttcagattttactctaatcaaaagaaaaaaattaaagtgcacttccaaatcagtacttatatgcaagagcttcaagaaacaaactagtatttaacttggtggttacatattgactgtattttcattgagtgaggttagaagagattgagaagcgtgaaatgaagttacaaagtagaaactatatggtgaactcaaggcaaagattgtccatagtaaaagaagacaaaataagaatgaaagagacaaaagaattgccaatgagttgtaatcttaaaagaaagatatatttaataaaataggattgattgttttgaatgtgggctgagaagtcctgccatcttccattgactctgctcacaggccttgtttgtgaactggcttccatggatagcattactctcctgacagctgcagctccaaattcagcatgaaaaggctggcaattctaagaggaagggagggtttaggccacttttaattctactttgtcattgcaagtttcttgcattgtttggcatttgttggtcttccttactggatttcaaaactagaacactttttcctagccttggaaccaaccacgaaaataaccacctcttaccctcatgaagaacactttaagtttttctcttttaaaaatgaagtctggaatatctccaaacatcttgtcactcacgccttcatttaaatgtcaccctctcaaccacaaggaaactaaaattgccccctacttgctactccctgttttattttctagtagaacatactacagttggagatcatctcatccatgtcttttattcttgtctcttatttgcctctgcttgactgtaagctcatggaaagtaagggaccttcaccaactagcaaagtgcttaggacctagtaagaacctggtcaattctaactgagtgaatgactgaattcctgtgagaagtcaacatgaaaattcctaggtcattagtttagttattggaactccaacactgtattggaaaagtgtcatggaaaggatagttagtggattaaggttttttataagaggaagagggaaagaaaggcattgtctttacttcaggcatttcaatggccatgatggagcctaaatattgtatgttgcattttgttttggttttgtgtgcacaagagctttgccagtggaatgaacgggttaagaaatgtgagttttcttttcgtcctgctatagagacttaaggaattgccccgtgtgagttccttgagggcagagaaaaatacaaatccatgaatacctgaaagccctgatttggcccctaagcaatctatgcatgtaacaacattgcatttgtaccctgtacatttataaacattttaagaaaagtataagagaaacacaaattttggttactcctctctgaaaactgctctgatgtcgcttggccgggggaattaagacctcttcctgtggcctgtggccactatgtgctcccggctctccaggctcatccagggccactgtgcctggggtcacagggttccaggatgtcaaccttctttcagcttctctgactcctcaagcatttttttttttttttttttttttttttggcttccaagacccaaacgcatgtctctcttcttggcacactcttcccaacttttttcctggctaattgctagttatttagtttgagattaaatgtcactccctcggcctggcgcggtggctcacgcctgtaatcccagcactttcggacgccgaggcaggtggatcacgaggtcaagagatcgagaccatcctggccaacatggtgaaaccccgtctctattaaaaatacaaaaaaatttagccaggcgtggtggcatgtgcctgaagtcccagttactcgggaggctgaggcaggggaattgcttgaggaggatattgcagtgagctggatcgcacctctgcactccagcctggagacaaagtgtgacaccatctcaaaaaaaaaaaaaaaaaaaaaagtcactcactcacagagggcttctcagatactcccctgccccctcatttaagttgcaccgcttgttgtattctcttataagccccattctttttcttcttggcattgatcaaattaacagctttattttattttagcattgtgagtgtatatgtgtgtttaatgtctgcttcctgactaaactgtaccctgcaggaaggcaaaactgtgtctgtgttgctcattgttaaaccttcagcactgaactcagtgcctcgaacataggagattccaactcaatatttactgcgtgaaggaatgaatgaatctttatgtccctcgtgcctaacataaagtctgccatatacaatggactaaaaaatagtattcagctaaaactgagttacggagaagatgaagtattaattgtattttttacagagaaacaatggtcagtgtatcaaaaatagagaccctgctctcagatatataacatagaactctcttcattcatttgccttcattttagttaacagaatctgttcatctaagtagagcagagaaaaacttcataattgctgtgtctgtgttattccaaaacatttaaacaaaaggtgaataactgaggtattcttccctgtggtacatacttgatgtgggcattttaaaagattgatcaaatctcctttcagctggatatttgagtaggcacaaccattacagaattttcctctagggacttactttagctcttaaactatgtaaactgaacaagcaaactcaagtggatcattatctatagaagtatagaattccatctccctttggcaaaccattcaaacccagaagtgtgttttacacattctgacagaagcatctgtaataaccaactctaacctcctttcttaccactttagcacccaaaagtataagaaaagaggacatgttaaggcttgttctatttattagaaaatatataaagagttcttggcttaagaactcttctggctatcagctccctgatgtgaaaaaagtaaatagcaaggggtagcatggagtcttactcccgtgtgacagacagcttaagaaagacaattggacatcatgtgactacatgattcaagctaaagtccagacacatcttttccataggccaattgaacattttctctgtaatttccacaataaccatttgcaccagcatgaatggagagggtctgagttcttctgggtgagtaaagggtgtgtcagttatctgtcctctgtcaccaggatttagaggcaggctcatagtgactcttgtaaagttgaggttcgcctgtggaggctgcaaaaaagagggaggaagagagagtgaggttcctcttggctctgtgccagggatgtgattagaggaccctgggagggccttcatcctacgaggggttggaagtggaaatggatgtgtgtggatgacctggtaacgtgtcacagccccttccaccccatagtagtcagggatttaatgcctcaacaaggcaggtctctgaaggagactgacttttctctctctctctgaatgatactgcctgagagaaatactcacttcctgctttgttttcaacaagtatggacttccttacacaaaaagaatcttttttgcttttgtccccccatttcactggaaatctatccactgggcaccactgttggtcggcttcctttcatagattcctttatgtttcaaattttaaaaagacaataatagcaacaaagtgaaatatggatttaagctaggaaaagcagagaactgaaacttttttcctgcaatcatacttcccagcttcttcagcaagatctgcttggctgggaacatgccttctgagaactttacatttctaaactgctgctaaattgctccatgcatttattcctcaaactctcagggaagatagcactggctttcagtctcataccaaccattcttaaggtaatggaccaaaagtcatttccacttgaaatataatccttctaaatgaatcatgcaacatggtttttacctccattttttcagaataactctaagatgatgatcctctggccatattttaaaaatttctcttatttgttttaattttcttccattttttctttaattttgtatccagacactgccttctctaagaggaatgacatttttgcgggttatcatgatatatttttagcccatttgccttgacccatagcttacaacagttaaagaacactaacatataaacatagagttttgcccaaggccattagctttgcatgttaacaagtgggcagaaggaaggctgggcatgagagagacatgctgtccttctggtgagatcatcaatcccattcttgtaaccttcagatcattgcatttgttcagaatcgtctgcagaggaaaacatctcaaagttgggaggttgttgaagagtcagaaacaaatgggtcctgggtaatttttcaaaacaggctttttgtcaattgtcagtcagctgtttaatattgtcaattgtcactcagctgtttaatattgtgctttgttataaggataggcactgtggtctcagcgttcttaagcttttacatttccgttatttggttttacttctgcattagtagagtagatgtagagtagatgccacctctaggaactctaccagcagcagcatcttagactagaagctccctctctaggactataatctctgtagcctccacttctcccaccccttatttcttctgagcctacttggtctttgatacttactataatactttctattctcttatcataaacagttttctgatttcattttcctctggtttcatactaagccccataatcagtcactgcaagattaccttctagaatttctgtgccctcaagttttctccatatctagagagtcagtcatctgccttgagccacatccactgtctactttcttcacttccatccccaggctgcccagcactgatgaaaacaaaacaaaaacaaacaagcaaacaaaaacaaaaacaaaaaactgactaggatctcaatctggtttgcaaatccatgcttctctttcttgacttctttagacatcaacagaattgacgcctcctcttgacctgggacacccctcctccttggtgctttcttctacctccccctgcttctctgtatgtcttttgcaggctcatctttctcttaggctgtcttcccccatctctcctctccctctgtgcactcaggcagtctcccttgtcaacccccaaaactgcttctccagaccccagtgtttctctgagctccaggtccacaattctctaaggtccatgtggatgtccctcaccatttcaaacttctcttccacagggagtccctggttttcactaccatagcatattaaaataccatgcatttcccttcataccactaattacaactttgtttcttttttttaaattttatgttttaaaaattatcttctgcccacatatattgtaagctccttttgagaaagacacattgctgtcctggtcattactatattcttatcaactagcaggggccgtggtcggggcttgtgttagtccattttgtgctgctataaaggaatacctgatgccaggtaatttataaagaaaataggttttatttggctgagggttttgcaaactgtacaagaagcatggcgccagcatctacttctggtgaggcctgaagcagcttttactcatggtggaaggcaaagagagagcaggcgtttcacacagcaaaggagagagcaagagagatgccaggctccttaaacgacctgctctcccataaactgaaagagcaagaactcactcattacggtaggatggcaccaaaacagttgtgagggatccaccccgaacacctcccaccatgccccacctccaacactgggatcaaatttcaatgtgagatttggagggaacacacatctaccctttatcagtgctcaataagctcgctgaatgtagaacagtgatataaggcaggggtgggccaagtataggcgacaggacaaatttggcctgctactgcttttgtaaataaagttttatttatttacaaaataaataaataaatacagtcataatcattggttacattttgttcaaagctgcttttgcattaaaacatcagagttgagtagctgccacagagactgtaatggccccacaaagcctaaaatagttaccccgtggtcttttacagaaaaagtctgatataaaggacagtctcacagcacagaggaaaagcatataacccaaaggaggaaagagtagagcatagtggactgcagagaagtttccctggacccaatctgtgccttgaaagatgagaaggacacctccaaaggcaggatgggggtgaggtggggtgggcggtggtgatccaagcagacagcacgggcaagtgttctggaaaacttgcctttgttcacaagtatcctgcagtataaattgcaaggtgggcagtaagaaatggacttgaagagattgaacaagggccagaaacccaaggacattgctaaggagtttgtgccttagcccatccagggccctagcagccttgactgatgcttctgaggtcctggaggctccaggctcaggctaccttcccatattctctgaaaataatatcacatttgtttagtaaaaaaattgtttactaaaaaattaacctctcagaatttctgcattcacatttatttcttctcatatcctcgagttagaaaaaggtatttctctcctgtgatgatattgattctgcactcatctattttcattactgtctccttccctccctccctcagtccctcccttagtctatctcactctaccatcttttcctttggaccttctgacattcaacatcttggtcgctcctatccagccacacctctgaccattcaaccatttgtcctcttgattggttccaccttgtcctatcacgctggatatgctgttgctcccaaattgcctccctctgccagtttcttgccccttcctccttctgtctctccctctctctttcaatctttctctccctcagtctctctttctctttccctctctctcaatctttctcttcctcagtctctctcccattctctttctctttctctcaatctctctcttcctctctctcttatcctctctttctctcaatccctctctccctctttctctctctcaatctgtttctctgttaatctctctttctctctccttctttctgtctctgtctctgtctgcctctctctctctctctctcttccctagtgagctcacttgctttcccagtttcagtgatttctattcagatatctccaaaatttgtatttccggatattttatgctttcatggaggccgtgtaaattggtataacctttttggaaggcgttttggcaatacttagtaaaaggttaaatgtttacaccccttgattctgctattgtatgtgtaaggattttttcctgcatacttttgtaagtgtagaaaatatatgtataggaataattgcacattgtttgttgtagctgaaaattacaaataatataaatgcctataatcagagcagttaaatacatatgaacacagtgaaataccaggcactcatttaaaagatgaggtatattttaacaagcctatttgaaaagatacccaatcttagcaagtgaaaaaaaaactcatcaaattgatatatttagcgctgtccctctctcaagtttcagacccacattttcaattttctgttgtcatcttgacttagtctcgtgaaattttaaactaatcatttttaagggaagatattttcttcccttaaaaatgaaattcagacaaacctctgaatttccctctttctgctaatttcttgctttcttttatcatctttccatccatcctaacatacagttccagaggagtctttaaatccttccttattgcctaacaccgaggatcatttgctgaaatcttgttgatttttccctcagatcaacaaaggattttcagaatagccctgatttctctttatcaccacggtgctgtctcacgtcttctctccccctcctcctacctgccgtctcttccagactcgtctctctcccccaatctcctttgcgcactgatgccaaattagtcacaacaaaagtgtttacgtgatcgtgtcacccactggtaagctcttaatggtcttcccttacacattatctcccatttcatctcaggagccttttattaaccactcttcacagtctgactcagccctctttgccagtttctctctttacaaatagcaaagtctatgagctagattactcaatattccctgaataggtcttctcttctcccacctcttggcctttccagtaccattcaatcttcctggaaattcctgaaatttctttcctcctcactcagtcaatgttttgagacccacatcaaatgctacatactatttgttcctttactgatcatgccagttggaaatgattcgaatctgtaaagcagggtgctatggaatgacatttcttatagccctttggtcatttgggagcaatgtctaacataatatcctccaggtccatccatgttgttgcaagcgacaggatttccttcttgttaaagggtgagtagcattccattgtacatatattccatattttatttttttttgctcatctgttgatggtcacccaggttgattccatatcttggctattgtgaataatgctacagtgaacttgggagtgcagatatctcttcaacatattgatttcatctcctttggatatatacccagtagtgggattattggatcaaatggtaattatatttctaattttgggcagggtcctctgtagtagctccataatggttgtagtaatttacatatccaaccaagcacgccagggttcacttttcctcatgtcctcgccgacaagcctgatattcttatttgcctcttagcgcttcagcctttccctcgtgacttaacggtgactcccttgagactacttgaaataataagtttggatggcaaggaaatacccttctgctgtcaccctttgccataagactgagttactttgtaaacaaagaagatttacttggtcttccatgcccaagacccttttacttttcatcgcttaatatttcatggccaaaaactgttggttcttccaatcttgtaaggccatttatctttgatcttgctccattcccttccatttttgcttgagaatcattcagttcttgcctgatctcacgtctttctcgcaacaccttactaatgactgccagagtgtccactacacactatcggtctcatttgaccacttccccaggcatgtagcctacctgccaagttctttcacagcagatattttgcagtgttgtaagagggctccctagcttgctatgttttcttactacctggcattaggaagtaaacatttttcatggcagtattcacttctagtaccaatttcttttttaatctacatgggctaactgctgtatcaaacagccatcaaatcccaatgttaattgcaacttacagtacgttgtgatgtttctgtctgtatactcattcagacacacagagtttaagtaatttgttcaagatcacaaagttagtaaatggtggcatcaagatttgaacccaggcagctggactcaagagtctaaacaactttcattttaaaattttcatctttcaagatatatcacttacaatttccatcttcatcactttcttccatacttcagagctgcatatgtaaacctcttgatcatataaatatttatggagtctcagcattttgagcacatgctgagagattttgtagcattgaagataaagaagctctttcaatacatctaatcttgccactattgattttgaacagcatcttaatttgttacctttttaaaaccatattgtacttttcttcaggacagctaaattaaatgtcttatgttgatcccctgggttttctcagtttccatttatcagtttccttttatataaagagatgctaatgggtaaccttacattttgtaaggcatatttttgaagatatacaagtgaaggtttgatctgtacaccctcgttagagctctttattttacatgtggaggaagagatgccttagggcttctgaaaaacaggcttttatttttatagaggagaaacttccagaacatgccatgagcaaatgctctgtcaagtctggttctttcccccattacttaagtgcaaatggaccacatttgaagaagataagtagcagaacaaggctccccacaaggggattttgaggtgctctgaaaaccagactgacataatccatggaggagttcatcactgcaggctgtcacgtctcacagtgggagtcataggctggtctgcttgataaactactcctgatctatgactggagctgtgtgcttcctttaaaaataaatcttgtttttccatgccccacgtgcttctcagcctcaggagcacctcatggatttagactaatcttgtcttttacagtcatgttacttccagattcctaggaatcaccccatttctgatgccgttgatccatccatacccactgaaattgagctaaatgctctagtctgatttgccccttgaagttagtatagaatattttggctagactttgaaaatgaagccctgaccacaatgcataatgacctcagtagacactgaagagttcctttgcatcaggcaagtgacaagtatctatctcatcttcaaagtccacatagatatgtgccagattgtaggttgacaaatcactttttcactagctcacgtggcaagccttttcaccttgtaataatgctagtgagagacccataggtaccacataattggccagtcattgagattcaagcaacatttggataatttagcaaaactatcatcagaatcatcaaagtacataatttttatttattatgcaaatagtggattcactaaagtgcttagaccaattaagttgctcccattgaaaaacagggtgattttattcttaagaatatatcaggataaacttcttgtagcctctaaacagtactgcttagaaaagtgcagcttcactgcattgcatatccccccagaagccctcaaagttcagatgtacaccacaaaaacatgaagcacatgtgtttgcatggaaggtaggctctggggtcttcctatcataatatgtctatgattaatagtcaacatatgccccctccacattccctaaaggaacatacacatgcatacacacacacacacacacacacacacacacacgtgagaactgaattgagagtttggggtatacaccatccctgagggcacagtctacagctcctaatgtgtgctgtagagcaagcattatattgttgacaggtaataattcctggttaggaataacaggataccagtgagaagaggctgagaaaaatacactcttgctggaagagtcaagaacgagctcttcgtgggaaactatgggagacgattgaaaaaggacaagaagaaaggagaattgttaagtctccactttctcagtttctgaactgaacttttgctcacagcaggtgaacacaggctccctcccacactgagacttcctcccctgccggtgtgcagtctgttaagtaaacagagacgttatactgagaaaggaacatttctctattttggctatgagttgttatttttaaagattcatcctccaaacattttcccctatccttgtttattttttcactagaaagaagatgaactgcttaaaaaaaaaattcaactccatgacaagaaaaacccacttctagtatgttctccccactcaatgccaatggagcctttggtgtgagcactctgccagccacacattgggcagcatacctcttgaaattcctgctgtgcttctatagagcttccatgcatccagattttcaaagtcaaagcaaaatgcgcatggcagtttttttctgactccttcaagttaaaaggccaacctctcccttgacatatccatgtatttatcagtatatctataggtaatacttaaaggtgatccttactgtgtgccacactccattctaagcactttacataaaaaacctcatttcactttatttgggaataggatgacaatttcttcaatattgagatgggttgaatctggggagactgatgttagatgcaaaaagctttctttctagaacttttcctgtgtcttgcacctggctttctccctgtcttgttcccattctagatctctttactgacagtgcccatggctttcttcttggtactctagtgttgagcataagaactagtatgtaataggctctcagtaaatcttgttgaatgaattaaagtagagcaagaattaaagacagagaagaagatcttcttgttggagttctttcttttggttgataagcaatgtgatttgacgtaacaatcttgagtcctaatcccctcatttggaaaatggaaataataatgctaatcttagaggtcacttctaagaagtatatgaatatatcagaagtaatcaacatttttaagtcaaagaaaagaacgtctgtgaaaaagaaaactaatgagctagttgaaaaaatattaattggatctttttctcataccttacgccaaaataaatccccaaaaatggttgcacaacattgtgaatatactgaaatccattgaatcacactctttaaatgggcaaatgttatgttatgtgattatctttcaataaaattgttataaaaatgaataaaccccagaagatcaaaaatttaaacataaaagcatggaagtatactagaaggaaatataagataattttatatgttatgttgtatatatttatatgtaaaatttttttatttatttttctttgcttttaaaagcaagacataatgttctagaggaataaatgaaacgttcgataaatttaattctctattaaatgttttgcagaagaaaataccaggaacaacatcagaagaaaaaacaaaaaaccataagaaaaacaattaaaaatacatatgacaaatggcttattactataatatttaaagaactcttaaaaatctatgtgaaaatgacaaataacagaaaaatacgtgcaaaggacaagagcaggcagtttagagaaagcctataccaatatattctcttatcaacagtctattgtacaagctatttgaaagcaatgtttgaactatcaaaatttaaaatacataagcccttttatctagcaattctacttccaagaatttattctatagctatctgtacacatatccaaagacataaacataaggatagtcattgaatgaaatgtttttaacaacaaaatacttgaaagcaaagaaatgtcacccaagaaagaagtgattgaagaaagtttagcattcagttcagtgaagacatattgagctgtcaaaaaaagttgatggagaactccaaggtctattaactaaaaacaaaacaaggtgctaaacaatatgtttagtgttcatattttaattgtttatatatttcacaaatatatatttgtgcatgcagaaaatattttaacttctttctaaccccgtcaaacacatcatgccaaaattcaacttgtgataaagaaaaaaataaatgaattcctttcgtgtgtagtatctcatttaaattcttcaacaacccaataaaaaagatacagacacatgtttttaagtactacatgttatgcacctttggtttgcttatttaatagttgcaactactaatgttaaattcttgatgccaaggttaaaagcctgaacttctaaaaatatcaagatctgacatttttctgttttcacagattaatctgccatctcctgacctccaacacactgctctatgttctttcatgctgctcctcctcccatgtttaggaccctcttccaaggaggcattcacatctctgcttgatgaaaccctacattatcttaaagcgtccactcgaatgccacctacttatataccatctcctgcaataccaatgggctcagcccaaccatagcccatagttattgtagttgttcttgtacttcaaaagcactacaaaacacaaccatcaggacttgttacattatttgaaggctatgagcatcttcagccgaggccctgtttttattcccagaactaccacattgtttagaatatagtagcagatcaatatacgtgtattagataaatcgtttacccagatcttgatcattttcaattacccataggttgaagaactccatatttaacatggcagacttgaggactgaactacctacctcttctaagaagttgaaatgagaatgttttattgatgggaaattatttttttgttttgccttctagaattcaaatgaatgttcatattccatgaagacaatggctgatagttttttgttaaagatttagaaccagtggatttttatgaatgtgaaccctttcatgtcttgtggaagattttctgttttttaatctttttatttatttatttatttttgctatgttttcataggaaccagggaaaatgtgtagagggcatggtggagatcttcgacatgctgctggctacatcatctcggttccgcatgatgaatctgcagggagaggagtttgtgtgcctcaaatctattattttgcttaattctggtgagttgataacacaagataactcaatgctggatgaaatgtttatttgtagttttcaaccagatacgatctacccactccaaaggcataatgtcataaatagaaagaaactactgacacacgttttaaaataacctaccaacattgcagattccttataaaggtagaaccatgctagccaaatagacacatgaaaaattgtaatttggcattgaatcaaatggcctttgagctaaaatttttgtatgctttcacagataggatgtttttattcaaatggtacatgtatatagacatatgttagttgatagttatattatgtctgaaaataagtagaccaagtaattctgttaagaaattgtgaccaattccaggctccagatagtaaagaaagagggttatttgagacagaccatgtttctggtcaaaactgactagctaaaaatatagttggcttagagatagaaaaacctgtttctaaaacagaagaatgtggaatgcaataaattgtccagctgaaagaacattttccatttgctctatgaagtctgattctactgccccttcgtatttatttgtttgagaaagcttagctaagagcaacatctgttttttgtttttgtttttgtttttgttttgtttttgttttcaatgtagtgaggctggctgttgtataaagagttactctatgtcaccaagatggaaactatggttcagcctgaattagtgccctgactcctcctagcctcttggtatttggatctaagctctagctctacagcctctgggacctaaagctcacattgggtatcagcggtacagcagctccccttaagctccacctttccccctggctctaaccccactttgtgcctcatccctcattctcacatagaaatcatagctatttcgaatctctgggcctgacttagtttcttatgccattagacatagtctcaaattcctcaatagctgaattgcagcttgtattgatcacatacatagagaatccgcacttccttctctttccacgtgtttttgtctctttctgatgagtgctgatcccttcccgcttcccctaacaattttttacttttcttccccaccactgctaggaacctgtgttgcttaatggaatcagcccttccttctcttttcttgtgtttttgtctctttctgatgaatgccaatcccttcccacctcccatgacaattttccacttctcttccccaccaccactagtaacctgtgttgcctaatggttatcacagtaatcattctcacttatcaactaataaatggaaatctgtactattacactaggcaaggactgaattacagaatgaagtcccatgataaatgatgtgatccacactaaggaagtgattaccactccattcaggtttctgtttccactcacgtgcattgtgcttttcatttcagtcgtttgtcctgtacattgtagggtccagatcccacaatggctctttattggatgagagttctgggagcagtgccactcagctacatggtgccaggtcctgaacctgtgccttctttggtggagggctggcacgtgctgacagctttcatgtgggcaatctgggaacttcagagaaggcaggcctattaagtgttaagactccccaccccgaacttttactgagaaaaagtaccccagacaggaagtaaaattagccagagttgtatgatccacacagtggatgctctgatctcagtaataaaaaatatttcctccagatccatatagacttttcctgcattattgttttgtttctgttcctatggcagagtgagtttttaaaactattatgcaagaaatatcaggatttttgccaccaaaaagttggattcatagacccagggtttttacaacccagggggaaaaaactttcagccctcacaagaaagtattttattaaagactggcacccaaacctcaagactatatttctcactgcaggatttggcccctgtctgcctccttctcagactagttaaactttcatactccatccttgttccttcgcttctttcttaggatcttctgtgcacttctttcttaggatcttcttggcacttctttgctcttgaagggcagaaacgctattgtagaaattcaaggcactgtatgctgacatagtttatagttgtctttttcatgagataacacagcggctggcagctcctcttttctatcaaggacagtactgctggctcaggagagcagtaagcaaacagaagctgtctctcaaccctgtacaaagcgaaaccactcttttccctacaaaagtgagctgtgccccagaaaagcggatctgctgctgagcagggctcctcatgtctcctattgttcctgaaaaacagcatcaaagagggcaagactgacacacaatgttgtagcattaggagcctttttcagaataaaaaagcaatcagtcatatgaagcatgtggtcataccacaatcaacaatttttctccacaactagagatatgggtttttctaaaagtccaactgattcatggccctgatacggggcagctctacctctcatgagaccaatgaccaagtgactctgactccaggaatctctgacagaagccaagctggaaacggctcaggaaacctgagctagaagatgcctttctgacacctgggaaacaaaacctcagtgtatggaggaacccaaggttttgtgttgagccccagtcgccaaggtctgaggaggctgggtttatattggccccgattttgtggccgaggcacaaggggaattgaaaggttgttgtgaggacctgctcggaatgtctttctggaagtttggagagggtctctcaaatgccaaaatttccatgggaagccattttcacagctgcttgggagtgggagatattcgtcatcatttctgccccatttagaataatttattactttgcttgcaaaaacccggaatcatccataggacacacgttgtttgtttttccactccacaccaaaggacagaggcattcctggttaatccaagatgccaacttcaagacattctgagaactagctggacagagctgaagtgtagggcaaatcagaacagaagtgatgggcccagggcaaaagcccgtgaagcagcagctgcggaggaaggatgggagctggagctgcaaagggggccatggtggagactctgggcctgcccacagtatcccctctgcccaatgggaattcagttttcctgcatatcattcaattatttctcatttttctaggcctagctcaccttattcgggaagttttgcgactaccccagtccataatgaatttcctctctagactatttcaattcttacagtcactaccacacagtctaggatttggttagttggttgatttcattcatttattcaataattcaatgtttattgagttcctactatggactttgtgccaggtatacaaaactgaatgttactgttgtgtggggtttttttctttgcatttttaaagttaacctggatttttctctcactctttatgcatgtatttcctaatctccctataaactatttgtatttttttggattcctcacagtctatttagcctgtggactgtcaacagatgttacatcattcagtcatttaatagatgcttatttgctagacatggccaggaggacctggaaagtcctcatttttcccatctgttcttaccattctgaaatgtatcatgctcttcagtgctccacagatctagatgatatcaaattattaaatggaaaaagcaagacccatctccttgggttattgtggataagggggaaattgtgtaggaagtgtctattgcagttcatggaccattgtaggcccttagtcaacaacagctatcatcatcactgatgagaatctctggcttaaacggagtaggttcatgccttttttcagtgtaatgaagtgttttagtttaaaggcctttagcaaggcttacaataaaaaaaagtggggactccagggtaacaccaacaatagagacgaccatggctgttatcctgagactattaattatgccacgtaattagatttagagaaaacttagagcaacatttatcttgtggataataattgattgtgattgggacttaccgttgagagaccctgatgaaaactctatggtgaattgctgtggagtcacatgggttcatgcatcattcatcagtgggccctggttttagcctcataacccctgagaatccacctctatcagaaaaccaccctttcagtgaaagttcctcaaggctcagaaaaattcatatgtcaaagctttatatgtaaaaacctatactctctaataaatgtttggtttggccttcacattcaatttaataattatttctacctcttttctaaaccgctcttaaccacagttctatatatttaattctgaagagcctcatgcacctccctccctggtaactttatctacttctctccctggagaaccagccagaccatgattccagccctctgtcctctcttcaaccgtaggtcctctttttctctcctgactcctcaaaccttctccagttacccggatgccttctgtgtgctgctggcttctgcatcactgttcacagggccacttgttcccctggaaatgtcttatgctcttgaaatgctatagccttgttcacctgttcatccaaaactgatcctcagacaacatttctctttcaattggtggaataataaagaggaatatgggtcaaaattcatagacatttaaatacccaaggtgcaaagttaagagaaaacaagataggagaaagaattatggcaacatctctaaaatgtgtactttagtgtttagcaaaaaagggactatggaatgtcaaacaggaacatatatgttaaacataaacatgaagcagtgccagctgctgtctgccatatagtcatgctttgttaatgtggcacatcttgccatgatggtgccctcatgaaacgaaggatgctgaagcagatgccattctgtttgctttgatcagaagccactctctggtcaaggaagtatttgtttcatgcttaattataacaagttctcatcacaaagattattttctttctccagatctggattgtttgcactcactttatattattagacaattactcagattgtttatgtttttatgtttagaaataagacagtgattcagagagtccctgtatttagatgaaagaacattttttaaacatattgactgtaaacactgaaaatcattaattctcaacagttgaaggtttctgacaggaacggcccttggaaattgtaaatgggcacattgtcaggtatgcccattgttgtcacattggagaagattggattctgttctctctggagtcctttgtaatgccaagcttcctctccagggagctggcttattgtcattattttgagataaatggcacttcatagtattaagtggttcattgtctcttctctggctgactgtattctgtaggcagccactcaactttggagcctttctctgctaccaacttttggtgttgccttaagcaagcctcatggctcctgttagtttcctgacaacatggtatagcatggactttgtcatcagagaggactgaattcaggagaagcaactctgccacttccttggcggaagggggatgactgatgtcctttgataagctgcttccctgagcctaataaaaaaatagaaataatgatacttaaactcatggaattgttgtgacaattgaaagaatgaccagttagtaaagcatcttgcaccatgactagcacacagtagatgcacatgagtgttactaagctttagttatgccctccaaatacaaagccttagttttgtcactatgaaagaaattactctgttcttcttagcaggtaataaataaatccctgcctggaaattctgcaggagaatttcacccctgcgctttcaggttaaaagattgcattcccatgatgaagatgttctgtgaatagaatcatctcaagtcccaaatggtgtggatttgctcctgcatcttgttgcagagattctcttggagcttctgagaactggggaaaccaacaaaatgcctgtagcctggggaaaatgtagggagttttagcatgaatttgtgggaggtgagaaaaggcagcaggtgtcgaaagacgggaaatccttgcactgttctagatgttaggagccattttccattcacattcagcacctcaggaggagaagctgcctatcactttgtgtcctcaagagaaccaacaaaggagaatgccatctcccagatactcaatttgattaccattttatcctaccttctctagggtccagacattatgtaaattggcattaagtttgaataatgtatggacccagtttaaaaggaaaaaatgctttgggaggctgaggcaggtgcattgcctgaggtcaggagttccagaacagcctggccaacacagtgaaaccccatctctactaaaaatacaaaaagttagctgggcacggtggcgggcacctgtaatcccagctactcaggaggctaatgcaggagaatcacttgaacctgggaggcagaggttgcagtgagccaagatcgtgccattgcactccagcctgggtgatgagagcaaaactccatctcaaaaaatttttaaaacaaaaggaaaaaatgctcccctgattcccgcagtgctgacttaaaatgttcttagtatgccaatgttgcttaaatatgaatgactgtagcttctacttaaattggcaaccgcaccaaatataaactgcaaatgtttatagctcttatggaagtataaaagcaaaacaaattcttaaattaaatacaaactaagagggaaactgataataacaatgttttgtgtaattaagttgctgtttgcaacatgcctggggcagactcctggcctctttgcatctgacatgagaggctaccaaggatgtggccacaactgggctctcccagcacttgcttgcgctcagaactgtgccaaaacctttgctcgcccagtgttctgcaacgtccgtcatttggatttggcaggaacacatcatttatgcattttgtttgcttctgtatttagttgagatacttaaaatataactgctagattctaaggcattcataagcatctgtgaaaaatgtgttacttaggaaacagttcagggttccatggattatctagattggtgagtcttaagactgaccacacaattcatctgggggtgtggaggaggggagctttgagaaaaatctctgtatgagcacccacacccagagattcctatgcaattatcccagagtggtgccttaatatcaacatttgtttaaaccatcccccaagactaaaatttgtgaccgggatttagaaccattgacttaattgatgcagaacactctgatattaatgtcttcatgtcttttggaatgtcattaagacaaaagcataaaattttaaaattcttaaagacaatttaaagacctatgagaatccatctttaattctcaggagcgtgtggaacctagtttgaaaactactggcatcgacaattgaatttccactaaaataaaatagctctctagtatattacaaaactacccattctgcaaactgcaggggagctactgataatgcttggaactgtgccaggcactgcctgcataaaaatgagtaaggtccacttcctccatggactgggttgggtaggaggcaaagataattaaccaattattttaatattatgagttcagggttgtaatgaaagtaagtattgagtgctgcagagacccagcaaaggagtccttagctgagaactgatcctttgctgagtgacgaggacattattgaaccgccaggcttgatggcatgttgcatggtaacagaccagtacaccaaacagcaggagctgtagcagagaaagagtttaataattgtgtggcagccaaataaggagacagaaggaaaccttaaatccacctcttgaaaaagtctgggactaggctttttaagagaattctggcaagaaggaggctgaggagctgggggtaactgattggttaggacataggagaggagacaataaggatatagaaactccattcttgcactgggtcagttcctcggagggggtcctcactctggctggcagcagtgaacccattggaatgcaggatctgaaaaatatctcaaaatggcaaacttgaggggttttttttagcatcaaagatgttatctatagaagttaggacattgtgacaggggctacgtgactttgaagtgttaagtggctgtcagaaagtgagctattgcagcggtccccaacctttttggtaccagggaccagcttcatgaaagaaaatttttccacagatggggtggtgtagggtggggtgggggatagcttcgggatgaaactgatccacctcagatcatcaggcattagttagattctcatgaggggcacacagcccagatccctcacatgggcagttcacagtagggttcacagccctatgaggttctaatgccactgctgatctgacaggtggcagagctcaggcagtaatgcttccttgcccaccactcacctcttgctgtgtggctcagttcctgacagattacggactggtaccagtttgcaacccaggcagctggggacctctgggctgtagggtaggctggttaatgcttagctgtgtttctattcaaagcttatgcttttgtttaaaacctagtaatttggttttgttaattttatgaagatgatttcaaggatgagtaggattagctggagtcagaaggacacaagggaatttctggcaacaacattaaactaccagtgaatgtctcatcaagtcactggacctctaattctaagcagtactgtcaaccttataggttatgatgtataagatagtgttgtgatgtataagatagtgcaaaaacctaagttaatatcaccatttctgtagtactctctatttcaaaggaaaaaatcttcagcagtctaatatcctaccaaaattttgaagtcaagacctccctacactaatcaaagaactagaggtgcaatcaggccatatatttggaaaggccataggtgccctccctctgtccttgttcccagcatactaaactatagtctaaaagactttaaaacttgaactgaagaaaaccttaaggaaacaacaacaaaattccatttatttcctgagcccaaaagtagaataattgttttttaatgaatttttctttccctgtaagacatactatgaattgttcaatgggtattcaaagcatatgtaatagaatatgtatgctttcctgaaaaattgaaatggaacatcaaactgttctgtaaagttttgagtctagaccaaactcacagcacttagccagaatatgtacatctgcatctgccactcatggccccatcgctccctccaactgcttctcttgggctgaaggatggaaaagcaaactccctgcgttgagttccatcttgccctgcatggcctcccccatggggtcattgagctccccaccagcttccacctcttccagcactttccgccagagggcccgtggctgcttttgcagactgaaattgattgtggttgattcagctccatttcctctgagtttttactttagatgtgctttttaggttgcatttttcttctggcatataagaaagacagcaatattccatggaacagagtgatgtctgtggctttgtcaaccgttgtttgttagcttgatcaccatttattgagtgtttactactttccaggcattgtgctaagtggtagaaatacaaagttgcctttacttgattcatctgtaaaatagagagagtagtagttcctacagtgtggtttatgtgaggcatagggactgctccctgaaacctagggacaactccctagcagcgacccagtgctcatatcaatagtggtaacaattaggaaggcagctcctacctcaaagacctcatgatctgatggtaaagacagatataacaagaaaattattctttttaaatataaaattgtgatataaaaatagttttcactaaattggatttttatgaaatttacagaaacaaaataataaattaaggaaatataaaaccacctgacattagccaaccatgttgatgttctgattatgttactgcaaaggagtgtagggttaagaacgagggactttgattccaagatcaaatccctttctgctatttcttagctgtctgactttgggcaagttgcttaaaccctttgtgcttctgtgtgcttgcccatgagatggagattataatagcgtctacctcatagggctatttttaatacaagttagctcttagaacaatacctacttaaactaacaatttgtattaggtactgttttattctccatccgtactgtgtatgcatatattcatatttatatttacatattctaattaggattatatacatgtactttctttaaaaataagattttaaataactatataatcagtcatgatgatacaacatgatttattcaacaaatctgatgctgttaaacacgtaagtgatttctctttcaggattataaataacatttgttttgcatttttttcatacatcttttgctcacttttcattgttactttgtatatgttgctagaaattgatttgctggtgaaaagggtataaacatttttaaggctcttgctacatattgcctgctcttcatacatattgcctactgccccaggaaactatcaattacacttttaccaagagtgtatgaaagcattcacatgaatgtaaccttatcatgcaatgtgggccatgagacagaggagagttatggagggtagacggcttccccgctgctcagccactgccctctcctctaaaagagccacagtcaggaatttctacatagatcctattataaacatctccttttgaaacaaattatcttctctcagagcattttcttcattttagtatctatataggtccttgttatgttcattttaagttttgtgacctgcactgacacaatgctgatgaactgcttattccaggcagtctgagttctcaaagcatttgcattttatgtcttatcctctgttttgggctctttgccactgatttttttttaagtgatattttaagaaagaggagggttgatttgttgtgagtgtatctctctttaaaaacttttctagggaaggacaacctcttccaaagactttgtttgctttgtgtgattggcatgtccttccctggtcagtaatgagcttgaaggaagctactggacacgggactgaacatggggttttgctatcactctagctgtgcctttctctagtgatcaaggagatgttggttcagaaagtgccctgtctaatcccactaaggcccgaaggaccaagtgctgtctactctccagattctctgcaacagaaagcagatgcttaggcttcatggtccaggttggaacaggtagttagctctgaggacagttatgcatgaatgtcaggaggggactggcaggggaacatttatttattctttaaaattggaatcaacagttatggatgaaacccagaatgcaaaattcactttcatcttgacacgcaacacatctgtcctttctccttgaatagcaagtattaatcattgagttagacaatgtaaccttcacattcagtgaaagccaaacactcagcaccttctagaaaaatcttagtgccatgctttcttagcatattgcaagtcctctgaggatgatgtgttgttcagctttgaagctgatcttttgtacttgcttatgtagctcaggctagtgataacatgccagaggcatttccaactaagaaaattattcacagaagctttaattacaaatttgttagccccacttcctgctaaaatggccagccttgaagagtttcggaaatgtgagcagccttaaggatgatagaaatattatgaaatagtaataagtaatacccatacagcaaactcctttttctttggagtatccgttcatcagccagatttccctctcaacagtccaggtgttgacgaagatcatgaaataataggaatgaaagggacttcgattttgtatttttaatagcattttcctccaccaaattacgaaagtaatgcatgaccaaggcagagaacttggaaaatacagaaaagccaccaagcaaaataatctcccaagaaatcataatttcaccacacaaaagtaaccattgtcaacattttggtgaaaatccttaattaaagagactcttaaaagatgccagttcgctgccacttcttcctttctccacaccatcctgcaccctgttttgaaatgcagaattgtttctaaatcattccaggaaaattattagttttctcaaatatctctggaggcgagtctgttggcagtcatttctagtttctcacaaaccttgaagttaggaaattatttgtgtagcttttgagcactgggccagaagtgagggatgtttgggttctagttccagctctaccacttatttaccaactggccgacctcaggcaagtccaggctagcggccccgcctcaagcccctccagatgcagcatctgcaaccccacttccttcacttcctttcgcctcagtttcccaacaatttcctagtaattgtactgaatcattgtttttcattttttacattaaaatttatttattttattttatttttaaagactttattttttagaacagatttagatttgcagcaaaactgagtggcaagtacagaaagttcccatatattccctgcccccgcacatacacagtctccctcactatcagcatccccaaccagagaggtacattggttacagctgatgaatctacatcgacacgtcattatcacccaaagtgcatagtttgcattggcgttgggcattttagggcttttgacacatgtatgcactattgtaatatacagaataatttcactgccctaaaaatcctctgtgctcctcctattcattcctccctccaccccattcctggcaactactgatctttttactgtctccacagttttgccttctccagaatgtcatatacttggaatcataaggtttgtagccttttcagattggcttctttcactcagtgatatgcatttaaggttcttccatgtctttttatggcttgatagctcatttctttttatcattgaatactactactccattgtctggattatacacactttatttatacattcacctactgaaggatgtgttggttgcatccaagttttggcaattatgaatgaagttgctgtaaacacccatgtgcaggtaattgtgttgatatgcatttttaatgcttttggataaacactcaggagcacaattgctggattgtatagtatgtttagttttgaaggaaactgccaaaccatcttcccaagtggctgtaccattttccatttccaccaacaatgagtgagagttcctgttgctccacatcctcatcagcatttggtgttgtcaatgttctggattttggccattctaacaggtgtattgtggtatctcattttgttttaattcgcattttttggataatatcacatggagcatcttttaataagcttatttgccatctgtgtgtcttctgtggtgaggtgtctgttaaactctttggtccatttttttaatcaggttgtttgcgttcttatcgttgagttttaaaagctctttgtatattttggataacagtcatttagcaggtatgtcttttgcaaatattttctcccagtctgtggcttgtcttctcattctctggagatcagtggtttttacactttcttctgctgaagccaagtattgtggaagaagccatggggtcaccagaggataggtgcacagggtagtgagggaaagttggagtgaatgggcttggtgcccccaccccgcaacatttctcttgctttaatcagagaagtttgacttcatccagattgcatatgaggactttacatgaggttcacctttttatttgttttaaaaggggtttttactctcaaaatgttttaaagaccactgaactagatgatcatcttaaggcccttttaagatttatgattctggaattctgtggctctatttttccaatgtaatataaccttcctctcgttaaggaaaaatgagataaacctgttataaacactcatgtgacattttttcaatacagttttcatccacgtagtgctcacttagaatgatagaaacaatacacctaaagaatatgcaccattcacttgcccactcatctctcaaagagaggaactttcaacactagttatctttttaaaaataatcagagagaattctcagccacttcaattctagcccaggaaaaagagggaaaatacatttgaaggtttctggctcatgtgatacatttgcaaaccagaaccaagatgatatgactctcatttattagtgactattgcaaagctttgcaggctattaagcaggctgttcaatttagggtgatatggacatgtgcatattggccaattatatatgctcagatcgtatgtcattttttttctgcattttagtctaagtgtcagataggtgtttcatgatgttttataaacacttctgttcacattaacattgttcattgatttggcaaggaatgaaggggtgtcattttcatgattttatttgtatattatgtattccacagaggatttgaaatgccttaccaaattttatgtaatgtaaaggggtaaaccaatatttgacacatcattataaattgaggataatctgaagaaaataataaatccaggagacagattatcacactgatatggtttggctctgtgtccccacccaaatttcatcttgaattttactcacataatttccatgtgttgtgggagggacccagtgggagatcatttgaatcataggagtggtttcctccatgctgttctcattgtagtgaataagtctcatgagatctgatggttttatcaggggtttccacttttatatcttcctcattttttctcttgccaccaccatgtaagaagtgcctttcgcctcccaccatgattctgaattctgaaccctccccagccatgtggaactgtaaatccaattaaacctctttttcttcccagtcttgggtatgtctttatcagcagcacgaaaatggactaatacagtaaattggtacaaggagtggggtgttgctgaaaagatagccgaaaatgtggaagcaatcttggaactggatatcagggagaggttggagcagtttggagggctcaaaaaagacaggaaaatgtgggaaagtttgaaacttcctagagacttgttgaatggccttgacaagaatactgatagtgatatgaacaataaagtccaggctgaggtggtctcagatggggatgaagaaactgttgggaagtggagcaaaggtgactcttgttatatcttagcaaagagactggtggcattttacccctgctgtagagatttgtggaatttgaacttgagagaaatgatttggggtacctggtaaaagaaatttctaagcagcaaaacattcaaaaggtgacttgggtgttgttaaaagcattctgttttaaaagagaaacagcataaaagttcagaaaatttgcagcctgatgatgcagtaggaaagaaaaacccatttttttgaggagaaattcaagctggctgcagaaatttgcataagtaacaaggagccaaatgttaatccccaagacaatggggaaaatgtctccagagcatgtcataggtcttcatggcagcccctcccatcacagacccggaagcctaggaggaaaaaaacagttttgtgggccagtcccagggtccccatgctgtgtgcagcctaggaacttggtgccctgcatctcagctgctccagctattgctaaaaggggctgaggtaccacggtttcagaggttgcaagccccaaaccttggcagctttcatgtggtgttgagcctgtgtgtacacagaagttaagaattgaggtttgggaacctccacttatatttcagaagatacgtggaaatgcctggatacccaggcaaacatttgctgcagaggtggggccctcatggagggcctctgctagggcaatgaggaagggaaatgtggggttggaacccccacacagagtccccactggggcactgcctagtggagctgtaagaggaggaccactgtcctccagaccgcagaatagtagatccactgacagcttgcaccatgtgcctggaaaagccacagacactcaacgccagcctgtgaaagcagtcagggttggaggtggtggtggctataccctataaagccacaggggcagagctgcccaagactatgggaacctacctcttgcatcagcatgacctggatgtgagacattcagtcaaaggagatattttgaagctttagaatttgactgccctggtggattttagacttgtgtgggccctgtaacccctttgttttggccaatttctcccatttggagctgctgtatttacccaatgcctaaacccgcattgtatctaagaagtaactagcttgattttgattttacaggctcataggcaaaagggacttgccttgtctcagatgagactttggactgtggacttttggttaattctgaaatgagttaagactttgggggactgttgggaaggcatgattgcttttgaaatgtgaggacatgagatttggagaggccaggggtggaatgttatggtttggctctgtgtccccacccaaatctcatcttgaattatactcccataattccaaagtgttgtgagagggacctggtgggaaacaatttgaatcatgaggccagtttcccctatactgttcttgtggtagtgagtaagtctcacgagatctcatggttttatcagggtttccgcttttgcatcttcctcattttctcttgctgctgccatgtaagaagtgcctttcacaagcataaggaagaagtatacttgctggagcagcaggctgtccttcttctgacgatatggactgcaagtgcctatgtttactttgaccaagacggcctttcttttcacagaaagccagggttcaccccttgaatttcataagacctctctttgcagtgggttagatactcttttatatttttatactctgtcaggaaaacatttttttttccatttaaaaatcagtcttttggttgcttccaagatggctgaataggaacagctctggtctgtagctcccagcgagatcgaagcagaaggcaggtgatttctgcatttccaactgaggcacctggttcatctcactgggactggttggacagtgggtgcagcccacggagggtgagccgaactggggcagggtgtcacctcacccacaaagtgcaaggggtcaagggatttccctttcctagccaagggaagctgtgacagactgtagctggagaaacagtacactcctgacaaaatactgcacttttccccacagtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaaggatatgaacacctttacactgttggtgggagtgtaaattagttcaaccattgtggaagacagtgtggtgattcctcaaggatctagaactagaaataccatttgacccagtgatctcattagtgggtatatacccaaaggattataaatcatgctactataaagacacatgcacacatatgtttattgcagcactattcacaataccaaagacttggaaccaacccaaatgtccatcaacgatagactggataaagaaaatgtggcacatatacaccatggaatactatgcagccataaaaaaggatgagttcctgtcctttgcagggacgtggatgaagctggaaaccatcattctaagcaaactatcatgaggacataaaaccaaacactgcatattctcactcataggtgggagttgaacaatgagaacacatggacacagcacaaggaacatcacacaccggggcctgtcaggggttggggggctgggggagggatagcattaggagaaatacctaatgtaaatgatgagttgatgggtgcagcaaaccaacatggcacatgtatacctatgtaacaaacctgcacgttgtgcacctgtaccctagaacttaaagtataataaaaaaaaaagaaagaaaagaaaagaaaaaaagaagtggcttttacctcccaccacgattctaaggcctctcagccatgtggaactgtaagtccagttaaacctctttttcttcccagtctcgagtatgtctttatcagcagcgtgaaaatgaactcatacacacacacagaagtatatctttacagttcccaggatggactgcaagtttggctctaaatttcctttgcctggccaaaacaaaaagaacacattttattataaggttcacaggcttttaattgaaaaaaaaaaaaaaacagttattcaacatgaaaactctttttcagacaaagttctacaaagtctatttctcacaagtaggactttggcaaggattgtgcaactgacaattcaaagtcatttattccgtggtgagaaaccggagtacagatctttaccagttaggggatgatccatgtgttttgataatcaccttggtggtgatcagactaaaggtctcctatgaaaaccattaacttcacactatagctgataggatgcactgaagcccttaccgctgactgcatggatgagagctaggccagagcattggcaggcagagtttataacatggggcaggaagcattgaaattctattccacctcttggtgtatcaggtcaggagtcaaatctcctatcttcctcttctggatcgctttcctcctgaagtgtctggcatagatgtctaggtatagcttggcatggtggtgtgtgcctatagacccagctacttgagaggctgaggtgggaggattgcttgagcgcaggagtttgaggctgcagtgagccatgaccacaccactgtactccaccctgggtgacagagcaagaccctgtctctctttctaaaaaaacaaaacaaaacaaaacaaaacaaaaagaaaaaaagatgtccaagtgtgttctggttactgctgctgactgctaaatttaacagctagaaaaaaaaagtttggactctatggatcataaatttggataagacacagagggaatggcttgtctcatgttcacaatgtctaaagtcttaaatggggagagtcgtcaaccaggggtaatttgagagttatgggctggaaccaccttgaggcatctttattcataggctagcaattgatgttggctgttggctgggacgtcagctggagctgtcaactgggagacctgtctgatatcccagcataggacactagacctctcacaaagtggcgagggctccagaagcaagtgtcccagctgacaaaaaaaaaaagtttcatagccttctacgacatgcacttagaagtggtaatgtgtcacttccagccctttctgttgattacaagtgagtcatgagtccactcagtttcaagggagagggcccagatcccatatctccatgggaagagtgccaagaacaccttgtagaaaagcttgtggataggagatattggtgtggtcatccttggaaaacacaatcttccacagtgtgcaagagaggcttcctgctctgcattgtggcttaattattgttgaaataccaggcaagaaaaggtaggatccagggaaacaaatgtatccaggatgttttggtctgccttttctaggaaaaaaggaaaccctcaaagcctctgagactaggtcaccccagtgggactagaagttccacgtggaaccttctgcaaactcctctgcaatagatggactgtgcattttccaaatgtgtctttacatcatctcctttctgaccttgggaagatagtaactgactgtggagtaggaaatccagaaccctgattgttttaaaatatattacagatacaagtaatgaaaagaaggctcctaaggaaaatatagatccgtaatggctttgtcccaaaagctattaggctataatattttattacaaaggctatatttattacaaaatgtatttaaataaatacttaatatttatttaaataaataatatttattttattattaataattaatatttaaataaatataatatttcttacaaaaattaaaaactgggactttatatttaaaggtgagacattaaattctttttaaaaagtgcacatgtaagatttttttctcaagtcaactgaaccagttcatcagtttcactatgaatgtgttgatgcaccaagtatttactttctagaacatctagtagacgtcactaaaaaattataccaagttgaaaaatgtcactgaatcagaggcatgtggttggttatgtagtcatctgtgccagctgggaatatagcaataccaaatgaacagcactgccatgttcccttgctgggttccagcaaaaacactcatcttcactgtcgtctctctttgagacctcttagagaggactttgatgagtgtatggtcttatacacactagtctaacaatacacatttgctcaaggattgggttacgagcaggctcttcacctttcaggtgaacaattacacatcaggagaaggatggaagtttcctatctatgaacaaatatttcccaaagcaataatctctttattcaactcacataatgagaagtcagttcctctgtgccataaagcaatctctttgaagtcttcagtaatgttgagggttttaatgttgagggctttatcaaactaaacattcaagtgtcttaggctttccccttagttctttgagcaaattggttgctatgaagtatgttagtgttccgaatgaatggatagcatgatgggggatgtctaggtggttccagaatttagattgtggtttccataacaaagtgtggcagtattggcattagggaagagaaatgacttctaaataacttctcaaagtttactaaagccttaagaatgtaggaaatggccacaaaaggaggtatacaaaacattcctctgtctttattcctctttatacaaacgtattcactttcccatcagcaagtcataaaatacttctcatcttgcattacagtaggacacctactataacaataggctacaaaatgtataatggctcaaacacctagcagtttatttcttatttacttaacaatgctgggtccacgaacatgttgatatcataaccctcttttatgtggtcactcagggactcaggctgttgagggctctgtcatcatgaatgggtggcttccaaggtcatcctaagagttatctccattctaaccagtccagccagaaaggcagaacaggcttggaggagcaaagatatccatggatagatcatcctcttaaagtcattgtagcattgtgatagggctcttttcacaaaacaaggatacagtccatgttttcaagattttacattttagtagccacaatacaaagaagctaagatagtcttgtgatttgtcatcatggctgttaatggagagtgttttaaaagcactgatatcagggctccaccctcagcttccaatcatcaggtttggatggaacctgacagctgcatcttgtaaaactccacgggagattctgagagacagccaagtttgagattcacaaaccttaagagaaaaaatctccttgaattgccataacaaactaccagtctaataaaacatacatattcctttgactactcttaaatgaaacaaataggtaataatttacctgtacatataattaaaaatgtaatgtattttataaccatcatataaaggagaaattatattaaactatattaaaataaaatgatatatatttcaatgcagatgcccaagcttgactaaagtaggaaacataataaagtaataaaatgcttatatgtacttataatgaatgtttggctatgagaagatgatcagaggctttttgtccaagaagtacaggcatatgaaaaagtagagcaagagatggacaccagactgagaaaactaaaaactaaccaacctatttgtgtatgataaaaggagagaaaaaaaattgattagtaaaaatatgctaccgtgtggtctgaatgtttgtcccttccaaaactcatgttgaaatttaatcccccatgtggcagtattgagaagtgggacctttaagaggtgattggttcaagaagattctgcgctcatgagtggttgaaaccattcacggaataacgggttaatggatcaatgagttatcccaggagtgggactggtagctttataagagaaggaagagagacctgcgctagcacactcagcctccttgccatgtgagccatctcgggaccccgcagagtccccagcagaaagaaggccctcacccaatgtgtccccttgacctaggatttctcaacctccataactgtaggaaatgaattccttttctttgtaaattatccagtttcaggtattctgttataaacaacagaaaatgggctaaaacacacgccaagaaaattgaaagactgtggaagtgaaagaagaataaaaaatgaagtaattttgcaaatgagtctggctttattataagtgtattgtcaaagtgattccctttgttataagatgaaaaagagccaaaatggatagaaacatttatcctatcttaatatcccactacattcaaggcaaatattcagtcagtctctagaacttaacaaggccttggagatgatatcctttggatgagcaatggagaagacaagatggattggaaaaagaaacaaacaaacaaaaaaacatgtaagaggctatcaggaaaactctggagacgatgtcaatgtaaaacagatacaaacctcaaaataattttaatatgtacattgcacaaaaatggacttcttatcatgttacaaatttattttaaaacatataggaggcaacaacaatatttcattgatgtgtactattttataattgttggctctaattttatttagtagagtcttacatctcctctctacatatttacatccggttgtattgtttttgtagtacctgttcaactgcactgaaatcatttcaattaaatgcatggttgaaaagctgacataatacattcaattgccaaattgcataaagtgaataagctatttaataatttggagaaaatatattccatttaaacttccttctctataaccagttcatacactggaccttttgggcacagccatgtgaaagcttttcaaaacttttcactacttttttttgagacggagtctcactctgtcacccaggctagagtgcagtggtgcgatctcggctcactgcaacctccacctcccaggtccaagtgattctcctgcctcagcctcccgagtagctgggattacaggcacctgacaccacacctgactaatttttgtaattttagtagagacaggatttcaccatgttggccaggatggtcttgaactcctcatctcaagtgttccgcctgccttggcctcccaaagtggtgggttacaggcatgagtcattgcacccagccactatagatttttatttgtagtagatttagttcagtagggcatttgagaggcataggaactggaacaaatccttcattgtttgggactgccttgcacattgtaggacatccagtacagtcccttccacgaagtggcagcagcagcctcgggctgtccaaacaccctgttagggacagtgccactcccggaaccacagaagaaccacaatcataggagaagcatacaacaaacatggtgttcatcggacggtcagcttcagtggcacttttgagcaagcacactatttggttgtagaatgagtccctggcagggcacccgaaaggctgatgtgtgactcatccctagtacctctgagaatgctgaaatctcctccttctccaagctgagtggcagctttctggtccagactacttaaattgtgacttgaggaattttcttcactttttcctttgagtcattctgtttttgatcaagatgcgatagaatgaaggattctttcagggtctgctgtcacatccttcctttgggaacagatagaaaatctggcctggcttgaagagtttgtcctcaaacatctggtaagccataggcatcagcatctcttacttctccagagacatttagatgtgtcccccatctccatggaggcccatggcaaggggacccctagttgtactagagcttccttctgggcacagccacactgcacaggcactgcagtgtacagcacagctcctccagcttccggaagactccattatctagaaaagtgctgagaaatggagaagggggttcctctggggtggagatggaaagaggaaaaggaagggagaatgtccaagcaaaatgagagaaggtgagggacagcagaattgagagtgagggagagggagagagcaagagactgggttgagatgtcttgtacatgggggtgtcctcgtggcttcactcccctttcgtttgtaccactccgtttccccagactcttcctaaatatccccttattggctacaagatccagattgcctagaagctcagatttgctgacagcacctcaagactggttaatgacatatagattttttcttgtttccatctttgggatttggagcaatctccagagttgcaaaagcctaccttgttgcaataatatttttgagggtccacactgtctgctcacttgctctatgctgctgggcacagtggtgtggccatccagggtgggagagaccacctgggatatggaaattaccagcagccctgttttgctcttgcagtggttgccaaagcacacgaagcattctgggaatctgaatttctgttgtttctcccaaatggcccctgaagggcaacaggcagcacacatggaccacattttgccagaaaagtccagaaagaagatggctgctgttgtcaactattggcatttcaacaggacctatttttatttctcagtatatttgcacaactaggaagcatctgctgacaaggatgagatgataagctgtattgatgccaaaacaggactagaaaaacaggcttgttctgcaaatggcctgcatcctgagagtccgtgttaagaacattctctctctgcaggcaatatctgctcttaaaacattaacacttgaaaggaagtaaggcttggaatccttagcatagttatgcacacactaggttctcagtaagtgcatgctggatgaaggaacccacacgcaccttaaggaggatggaacattggcagcccaagaaaaaagtcactccccagaggccgagtgccatgtctttgacctccattggcaaggtcatggtgaaatgctgtctcttggggtcgctgaggtcccagcacggtgtgccttcacaccgtgcaaacaataagaagagaagagatgcacacatgtcacctttccaggcagggacatccaagctgtttgagtctccattctgtgatttccttgaacaagaaagggattattggtgaatgaggccagcatcctgggtgggaacaaaaaaggaaattggtagaaagtacatcatccaagtgggggtaactcagccctgtggcttgggcggcttcctaggatatccaaccggaggcagaggctctaggggatgtgaggctgcactgggtatgatgacacagaggactgtgagaggcagagaaaaggggagaagagctgaggccctcctagccctaacctcccagctcacaccctctgctatctgccacctccaggccaacaccacggccatgggaggtttgcccatttttctgatagacacattctttctctaccaacagcccacatggaacataagtgaagtaattcagcagtttccttcttaatctgctgtctctctgctgcttactcattctgtgctgtttgctttagatcaaggtgccccagggtaccaaaagctacattatcctattcaactgcatggaaaccaagatcccgaccattctggtttgttgttattgttacgttagttttaaaccttagccattttccattctgggcagttacaactctgtttactatgagttcctctgtgtagatgtttctcccatacccgacctacaaactgctacgtgagcagtaacttgtcaccatgttatccgcataaagtcagggattgataaacttgggagcctttagctcttgaaggtgctgatgaggaaggggagaggggaggagaaggaatttgtttgtgagatggtcagtgggctgaatagtggtatgaccaaaaagtgttactataaatacacataatctggaaaacaaaaatactgtcatctcctccctgcaaggcgctgtgattaggcaggatggagcttattgctgcagtgttagaaaatgcatccttgtagtcccaaaaaagcctgttccatcctgcccatctcttgttctcaatacttcttacttcacggtcactcattttcttcctgtccttgggttgaggtctcaacttcttgtaatagaattttttcagttataagcgacagaaatccaactcacactatcttaagcaaaaaggggattcactgatacgtgtgttaggaaggatatatgaaagctcaaaggtcaagtgaaaaaaatgtaagaacgaagaccttggtggggtgtggtggctcacgcctatcatcccagcattttgggaggccgaggcaggtgggtcacaaggtcaggagttcaagaccagcctgcccaagatggcgaaaccccatctctactaaaaacacaaaaattagccgggtgtggtggcaggctcgtgtattcccagctacttgggaggctgaggcagagaactgtttaaacctgggaggcagaggttgcagtgagttgagatgtgccactgcactccagcctgggcggcagagtgagactctgtctcaaaaaaaaaacaaaaaaaaaaaactaagaccttgtgactactacctactacctggatctctctctctctctctctctctttctctctctctctctcacccccccacactatcacctctccttgttgtcagtagtttcctttctgcagacaggagttccatgtgctgggaagagggccattcagagcctcgtattctcatcctctcagtttagcaatgcgagaagaaaaaacttttgtctcacaacctcatatacaatctcagaaataggctcttattttctggcttgaggctgtccagaggcaccaggcactgtgatggtctcactttctgtcctggatctatctgtggggcccagacagcaggatctatttcagaaaataggcgagagaggaaaaacttatgtggccgtaaaaaacagcggttttcaagtggcctatccccatccacatcataaacttttctgctgaggcttaaaagtgcttagacttcaaacttgatctaaaacagaaatcctacctggaaaaatcaccttccagtcacttagccaatcgctcatcactctctgtctctgaatctcaccacgagtttcacacgtctcccgagagagcgtctcctttatcattaccacatgtggagtcagcagattgggtttcatctaagctctgcctacctactatccgagttccctagcaggttagtgactttctctgcctttttgtttcttgatgtgaaaaggaacaacagtggctgctcacagggttgtcagttacatggtcaattacattacatggacaattcatgatggtgtcagacctgtctgagaaaaggtggcccatgttaccatgacaggccccaaggctaacagcccctttctgggtcatggctcatacaaaggagccctccttggtttgctggtgctctgagacttgcaaatgcattaggaattttacactgtaacccggttttaaatgggtccagagcatccccattgctagactactgtgctgaggaagggcactggctcattgttacatcccatgaacactctgggtctcctagacctcatcctctttgagcttctctctctcactctctctctgcgcattcaggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgaggtgaggcatctgtgggcttcctacaggagagacataaagaaaacatgcccccaaacctatgtgacagctggccgggaaggactggtgcctgcatatggagagtgcacttgtgacagttcctggcatagaataagcataaatgctataggaggacagaagagagaggttttaaatctgcgagggtcacagggcaagtgtcagagaaggcatagaggaagcgatacttacgcttggtttaaagcatgtgctttggggcagtggtttagagattgggtgcagtgtgcaaataggaggagggggccaatcaagagaagtcagtgaatgtacacatcccctgaagacactgggtacatctgttatggtccctgtgtacactcggatattctaaatgagagaccctggggccagatgcctcacggagagtcaatgttgactccttcatacctgttgaaccccttcttgtcacccccattgccattaccctagtctaagccaccatcattttctgttggacttctgtgccagtcactggatgtgtatccctgcctgtaatctagatcctttctagatcattctccatgatgtgtccagagtgatcattctagaaccaaatctgatgtcatcctcctgcttaaaacccttaagttctcattgcttttagataaaatataaaccctttcactttgtttttattactccttatgattcagcccttacttagcttacaaggacttcctcatgtctgagctctagccataatagctgactgttggatgagtcatcggggggaggttcttcttcaggctgcagattggcggtcagccctcctgacctcagctgggctcactcacacatctgggaggcagctgcctgaggccagggtgactctgctctatgcctcatgtctcctatcctccttgtacccacatgttagctgggacatgttctcatcgcaatggcagaggcatgagaaagtgatcctgtttgggcaagtgcattttactcttttctttcactcatgtccactgacatttcattggccaagcaagcatgtggggtgtccagagtcaaagagggacatgttgccggggtcatgactatttctgagcaataatctaacctatcatagctcagatctcactccttgcaggaagcatctcctaatccttaagacctagttggaacttacactctgttcttccctatggttactgcccattttactatttttctgcccatttagactgacaactctgtgagccatcattgcaatatggcttgcttacccaatatcacctagcatgatgtagagcacatagtaaatactcaacaaatgttttctgtaagagctaaggaaggacatcagcagacaaaatagagtctttctatgccaaaaggtgaaagtggtctcatttccattccattgtcctgtaatttggctagccaaaagcttagtggataccattcccataagtagacctcatctgcagggaagagatggggagactgctgggttatttattgcagactccagcaggaccacaacaatgattcaaagtgatgacactagaaggacaggtgccaatgggtgatgaagccacaatgacgatgtcaagtggtatcactaaaaggacaggtactcatgggtgatgaagcctacatgaccttgggcttacaccaggaccctaggaatgaaagagattccttctcttagtggctatgagggaaggcctatgatgtcttaaggaggttggattcgatcatttttaagggaccttcaaatccttagaccgtgattcaaatggtaagaagtttgctccattaaactcccaggcaccaccctttccggagacaacctttaaaaattattagctcctgggaaaatagatgtatctcattttctttgtatccctcacagtgccatatgtgaagacttacatatggtatatgcccccaacattactactgagtgagtgaacaaagaaatgagggaatgaatggatgaacaaatggctcatggcaggcttttccctgccctgtgaattcggcttctacttggtaagaaggtgattgcaatctctgttctcagggttccccaaggattcctgtgtaacagatgaaggaatcacgtctgtcaggtagagtaggtgactgcattcagagtatacatttccagtctcccctgtctttttcttttgatgagtattatagagagggaagccatgagtggattagatgccaaaatccctggctgagagaataaccttaccctggaggaaaacatattagctttgactctgagctgggaatttcggtgatgttgtagattcaatgcattgcagttgggtgtttttatttgttgaaaggaattgctgaattttcaaatccattaactgcttgtcagcattagcaagcctaattagttaatactaagtaaatttgcactaaatatacaaccctggctgattttactggccacgtctggcagagggcagcagcagggagaaagctctgtagagtttctgttggaatcgtgtgaaaagctggagaggttgcttctctttctctctctctctctttctctctctctctctgacacacacacacacatacacacacacacaattgtaataataataatattttggttcctcactaagccaatctaaatcgcagaagtctattttgttaagtaagcttggccccagccatatgttgctactcagagaatttaatatcagatttcatctgactgtaaacgtgaatcatcaggttgcacaaggaacacagtggcagatccagggggcatttaacttttatagcattttaaatgaaaaaaaaaaaaagtaacacttaaacaagtaatttagatcatgctgtaggccctgaatagctttgatgttgtgttttcatggcaagtctccaacttgagctgaattttcccctactaaaaatgcaaatttttctaagaccttctcttggtcctgctactcatgatacatatttcttttaaaagaaatttcaaactagataatagttgttctcctccccacccccgccaccagtagtgtggtggggcagcagagttgtggctagtggaggagagcagaggaggagagtagggaaaggagaatgccatttgcctacatttccctctgcccatttccccctgcccatttccccccttgttttcctgaacgtgaactgagctctgggcactgttttaggcctagcaggggacaggataaagcctgcttctctaggaattcgcactgagggtgtgagtgtgtgcacgtgtgtgtttggaggcgggagaataaacacaaataaataaaaaggagaatttcaggcagtgataagagtgctgagaaaaacagaacggtgtgaaagaggaaggctgagcctgcagaggcttgaggctgctgccactgggtagcggtaggcctttccgaggaggcggcatttgaagaccggaggaaggttcatcccagcaagtaggaacagcaagtgtaggtcccctaagtcttgggggagcttagttcctttaagggcagcacaaaaatcagtgtggctccggagagcacattaggggagagaggcaggaagagcttggagacatggatggaagctggaccagttgggccttgttgaacatggaaaggcatttagatcgtattctgagttaaatgggaagtgacgtgagagatttaacaatggagcgtcttgaactgctttactcatttaaaatacccactcctgcttggctgaatatctcatgttgtctttttagaagctttggcgatcctatttgaatgcatttaggtcctattggaggggaataggatctcatttgaggccacggaggtccatggaagtcacctgcatagcaaataccctgaaagtggctgcagggagagtgtgagggtgggaccgccctggtaggaggtggaaaatgaaaaacacacggccatgagttccagattagggcttctgaaagccctcagctttcccagctcccatcctaaagtgggtctttaaacaggaagaaagaaagattgctaagtgtctttggagttcctcttccttccccttctagggatttcagcactcctggggctcgggttggctctaaagtagtcctttctgtgtcttcccacctacagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacctgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaagacaacgagtttgttttttgtaagctccacttcttgctagcagttcaccactgatcctctaaaatcaaggtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcggcttccttatcaacaatatgatgataagtaataacacctaattcacacgatggtggtgaggactaactgaggtgctcattaaacatagttgctgttttttaatgcctggcccaaatccttccctgtgagggagaagaaggatgcttgagagtggttatttatgaatgaatgagtgaatggaagaatgagtgatctgaaatgatataattagcttaaaaacctctccctcattctgaaggtaaagcaggaacaattggtccacccccaccccaggtttccatttcaggactcccttccctttttggagctacctgcgtgcttcctttacccattttctcagatttaactgatgaattgggagggggtgggtataggacttactgagatgcaacataatattcacacaggctctgcagctagattactgtttgaatcttcattctacctttttttttttttttttttttgcatcaccttgggcaagttgagttccctgggcctcagtttcttgacttgtaaagagagatgacagtgcatctgcctggaagggttcttttatgaagaccacatggttcgctcatggagagtatggaaggaccgtggctgacactgcttctccctctccagagtcttccgaaactgcacgttggactcatttctttattaggatgggttgagggtcttctcattgtttgagtcacatggatttcaggaaactaattcattttcttgtccaagcattcccttggcaagttcttcaatccctgttttcaatggtttcctcatttctaaaatagaaacaagaatagcacttaccctatagcagtactgtgaagattacaagactggacatgtgaagtgcccaggatagtaccacacatagtcagcactcaatccacattagctatttttatcacaattattgttgccctgtctgagcatctacatttaatagaatgatggatatgtttagatttacatttttcacgttattatcgttttgtacatgcctcctgtctttgttcctctgttcttactgcctttcgttgttttagtgatattatggtacaataagaaatatatatttggtctctggccccagtttctgagacaatttctaaaactcttgtagacaggggtgctaggaggctcttttgttctaatatttggtctttgaccctggtttctaacacagagctcccaaatcccttggaatttcctgggcaatagaaacttcttttgttctaatgaggcagctcctggtgggctcctggataacctcaggatggggaatcagccatggcattaaagggttggaactttcagctctaccctttgacctctggagaggctcttgagaggctctggagaggggctgatggttgaatagatcatcagtggccactgatgtaattaatcatgtctatgtaatgaagctgccataaaaaacccaggaggacagtgttgagagagcttctaggttggtgaacacttgggggtgtctggaagacagcccacctggagaggacacggaggctcttcgcaccttcccccatacctggctctctccatctcttcatttgtccatctgtatctttttcattatattatccttgataataaactggtaaatataagtgtttccctaagttctatgagccaccatagcaaatgaatcaagcccaaggaggggtttgtggaaactccaatttataaccagttggtcagaggtataggtgacaacttagtactttgcaattggtgtctgagatggggggcagtcttgtgggactgagcccttaacctgtgggatctaacagaaaacctttaaccttttccccccaaattgttaaataaatatttttagggtgtcattttaattcctctgttaatttttttttttttttttgagatggagttttgttctgtcacccaggctggagtgcagtggcacaatcttggctcactgcaacctctgcctcctgggttcaagcgattctcctgcctcagcctcccgagtagctgggattacaggcgagcgccaccacacctggttaatttttatatttttagtagagacagtgtttcaccatgttgggaaggctggtcttgaactcctgacctcaagtgatccgcctgcctcagcctcccaaattgctcagattacaggtgtgagccactgggcccagccaatttaattattttttgaattattttcttagtgattgctcagtatgcatctttttttttttttttttttttttgagacggagtctcgctctgtcgcccaggccggactgcggactgcagtggcgcaatctcggctcgctgcaagctccgcttcccgggttcacgccattctcctgcctcagcctcccgagtagctgggactacaggcgcccgccaccgcgcccggctaattttttgtatttttttttttagtagagacggggtttcaccttgttagccaggatggtctcgatctcctgacctcatgatccacccgcctcggcctcccaaagtgctgggattacaggcgtgagccaccgcgcccggcctcagtatgcatcttaatctatcacagtatatttcaaattaatagtaacttaaatctgatgacataaaatgaaaatatttgctccaatgcagctccattctcttattaccacatatattatatctatatatgctataagctcaaccatgttattttattgccttaaactactttctatctttttaaaaaaattgacaagaaatgagaaaaaaatttatggactttagaaatactaatctgcgtatttgccaattccagtgtgcctcatttcttcctgtggatttgagttactgtctggtgtcgttttcttttagcctgaagcaattcatttagtattttttgtaaagtgggtctactagtaacgaattatcttggtctttgtttatctggtaatatattaattccaccttcatttttgaagcgcggtttgtagtttttttgaatgtggaattcctggttgatgatcattgatgtttttgtttcagcactttttgttttgctttgttttgttttttgagacagggtgttgctctctcacccaggctggagtgcagtggcacaatctcagctcactgtagcctccatgttccaggctcaagtgatccttccaccttagcctcccgagtagctggaagtacaggcatgtaccaccaaacccagctaattttgtttgtttgcttatttatttatttattgtagagatgaggtctcattatgttgcccaggctggtcttgaactcctgggctccagcaatgctcctgccttggcctcccaaggtgctgagattacaagtgtgagccaccatgccctgcccagcactttgtatatatcatcccattgtcttcaggcctccattgcttccaatacaaaatcagagccacccatgttttgatgctcacctgtatctgacaagttactttttctttattgcttttaagattttatctttgaacagtatgactataatgtgttttggtgtagatctttttgtatatattctacttgggaatcactgaacctcttgaatgtgtaaagtgatgtttgtcatcaaacttgggaagttttcagccattgttttttcaaataatgtttttcccccttcatctctcccctcccttgctgagactctctttacatatatgttggtatgcttgatgtcaatcccacaaatttctgagcatttatttattttcttttgccttttttcctctctgttcttcaaattacataatttctattcatttatcttccaggggactgttttgtttttcttctgccttcttgaatctgaggttgagctcttctagtgaatttttatttccattattgtatatttcaactacagaataaaaattgattttttaaaacttatttctgtctcttaagaattcccatttgttgattcattgttgtcatactctaattctttaaacatggtttccttcagatatttaagcatatttataatagctacatcaagtctttgctaaatccagcatctgggaaacacatagtttcttttgacctctgctattcctgattgtgggccacattttcctgtttctttacatatgtcctaatttttattgaaaactgaacattttagatactctattgtagcaactctggattcttattcttccctgcttgttgctactgcttgattttgttgtttttattcattttttaaataactcacctgaattaaatatatgagacttgcctctactagtatttggcttctgatatttctgctaggttcttaaattattattcctgtttttatttttaagcctgactttctcagagttgcccctatctccacagctgagcgtgtatccaatgactaggctcaaacaccctaacccagcaaggcttctgtcctccaccgatggatctgtatgtggctggagaatgcattcaattttcaggctgttttcaactctgactcaattttttgctgggcccctttgcatctcctctgcacatgcacacagccgtcatggtcagacaggagtcaggggctagctagcctgggcacactctgatctcccctaggcatgtttgcagcctaagccaggaatgtgcttgccacggccacaacctcaagctagtgaagacattggccctgcacactcatccaccaaatcaagtgagctcccctgtgactgcagcaacaaagctgtcggtccttctacctgccttgttctgttgctgaccaaactgggggaggtaagggtgggagcagccccaggcaagaatgccacaaatctgcactgtacttatacaaatttcagcaatttttcaatataaacatttctcagattgttatacatctttggtcaacttgcagagtgttgaaatagttgtttttgtcaattttgttcaaccttatagtttctttttggagtgaggatttaccaatactctctctcagccatagctggggatctcacctctccacataccctgtccatcctttatttctcttatcagaacaccaaggagcagacttgtctacatatgccatgtgttatttctggggatcagcaaggttttgagagaatactgagcaatctatggagcttttaaatgtacccattggagtgtgccaatgtaggaatgcctgactggggctggattacatactaggtaaagagcacattctccagtgttagatattcttaagcctttgggaacatttaaactcagaattaccacgtttagatttgcttctccaaaaatacagaatgtacgttgtattagcccattctcacgctgctacaaagaaatacctgagcctgggtaatttataaagaaaagaggtttaattggcttacggttctgcaggctgtacaggaggcatggcagcatctgctcagcttctggggaggcctcaggaaactcaatcatggcagaaggtgaaggggaagcaaggacttcttactttgccaggaggagaaggcagagggaggtggggaggcgctacacacttttcaacaaccagatctcacaataactcacttactcactatcacaaggatagcaccagaggggatggtgctgacccattcaggagaactccgtcccatgatccactcacctcccaccaggccccacctccaacactagggattacaatttgacatgagatttgacgaggacacagatccaaactacatcatacgccttaaataagtaaattttcatagttttcattatttggactatgtgcattaagaagctagttttaagttcacattcgtggtggcttacagttaaaatatttggggctgggcgcagtggcttacacctgtaatcccagcactttgagaggccaaggcgggcggatcacctgaggtagggagtttgagaccagtctgggcaacatggagaaactccgtctctaccaaaaaaaaaaaaagaaagaaagaaaatacaaaattacctgggtgtggtggtgcatgcctgtaatcccagcttctcaggaggctgagtcaggagaatcacttgaatccaggaggtggagtttgtggtgagccgagattgtgccattgcactccagcctgggcaacaagagcaaaactctgtctcaaacgataacaacaacaacaaaaacagttgcaatatttgtgaataccaccaaaagagcagagctgagaccagagaaaagatgttcgttcaagacagagatacactttctaacagaactgcctatagataacctggggtgccggttgaagggaagggtggggagaatttcctgcaacgggagacacctctgcatggatccataaccatgaagctacaatgttgttgaaaagattccctcagcagatggaatgttctttgatttttctttctactgtgagacagcatacacacccacattcatacacacaaaagctacgtaccagttttacaccactttttcaggtaatcctcacagctaccatataaggataaattattatattttacagatgaagaaactgaagcctaaggcagttaagcaactcccaaaggtcagaaatcttgtgaatggcagacatgaaattagtcttcctgactttaaacatgagtggtacttcttagaccagggttgagcttcctaggaattactgagagttgctgagtacatatggaattttactcaaggactagagtgaatgttagttttgcatgtaatgcctgtcaatggtagactggataaggaaaatgtggtatatatacatcatggaatactatgcagccatgaaaagaatgagaacatgttctctgcaggaacatggatggcgctggaggccattatccttagcaaactaatgcaggaacagaaaaccaaatactgcatgttctcacttataagtgggagctaaatgatgagaacacagggatacataaaggggaacaacacatactggggcctatcggggggtggagggtggaaggagggagacaaacaggaaaaataatgaatgggtactagacttaatacctgcgcgacaaaataatcggtatgccaaacccccatgacacacatttacctacataaccaacctgcacatgtactcctgaacccaaaataaaagtttttttcaaaaattgcatttaagcaagctttcacattttctgaggagaaagaaaaactcataagaacttttaacgcaaaaggagtatttcatcaaagaaatatgacaccttggacaggatgctgaaagctatgtccatactcaaatcctggagaaatgtgtcccggttgtctttctggtgggcagccgttgggtagggaagcttgaggagcacttccaccatcttcctggcacctgggggtgccagtgctcttggtttctgaggcccctttcctgcctctgcttcctgctgaggagtggttttcctctgtaccttggcaccaggaggagctctatttctagccgatgacctgagaccttgaagcctgcagcggtggcaccctcactagcagcagggcctgtctcagcctctgacagtttctggggcaggctcaccctccccccgttgccacaagaccatctcatggcccaggaagggaccacagcccacagtgaaagcacttggcatctatgtagaactgacaaactaggaactgtcacctcactaaatgaacgtgaaaaaagataaaactggagcaaggaagcctttgggcaaacatttaaaaaagtgatttcgaaagtgggtgggctgacctcagtggccaggccaggctgggtgcctgggatgcactccaaagtggcagacgctaggccgtttgccaagagccagtcgccccaagggttgcaggacagacagccctccgagcgacttcccagattcagtgcgctgctaggcctttctgcggacctgcaacctgccatcagctgccttttcattgagaaatcagtaattgtgggaaaggccagtgaaaggtttgtgagccggttaacatttttacaagctgattaaattctcaagttcaccccggactcaatggagtttaagctgaaaagattcctgagtatttccacatttccaaccagaaagaacatgtttcaatacccagggccccagaccacaggctggaagggaggggagaagggcagagagagggtgcaggcagctgcaggaaccgtgtcgctgtctcggtagctgctttacacgtggtctcagtgccttgaggacgccaggcgcagaccagttttggggctcaaccccagcaagggaagcatttccttccaattggagggaagggctgatggtgccaaaattggagctgccagatggttccctaagaacggattacaaactagagtaaacactccatcaattcatctttgaatttattactaaatatttttaaacaccctttaacaatccctacaatctaatccattctcaaatgctaaagaaacgtgtataaagaaaaacattaagtgggtttgtcaaaagattggaggtttggatggaaaagtttattttagttacttggcaatgttggtacccactggttttagcccagcatcacaagaacctgggtccaggcagcagaaagacctgaacccaaaaaggacagaactcaaggcagctccaggcttctgtctatggaaaaagcagctaaactttgatctaggtttaaaaaacaatggaaaggcaatgtcagagaacttgaaacaatatggagatttttttcctctattttctgtgattgcttagaagcagaaagttaaaatagatgccctttcaaatttcctgtatctcatttcaagtcaagtgtccccgactagtgagttcctcctttccccagcaactctgtgacactggagattcaagacctcagcagctaccagggatatttaggcctctggagtacacaaaggccaccaaaggaagaaagggcttaacaatgcccccgggatcccatcaagccaatcaaaaggattgaaaaccctgaataagcaaggtttatcaccagccaaactatgtcaccatcctggtgccacactgcccattcccaccgagctctgggaaaccacctatgtgctctccttgccggagggacatacccagccccagaacgaaactctgcagaggggccagctactggcactcctgatgtcagcaccagcagctgacctggcaggcgcccaaccaggaaacgaacaagggaaactggaagcggccaagggatttgcagaaccttctgagcccactgcaaaagaccatgccatttccattctgaagacaaaaacgtgaagtccctgttcccaagaccccctacagaatccaagaaaaaacaaaaagggaacatcaaaatgaaagagagaattcttcatggatggatgtcacgaacgtgttttcagggaagaaccccaaatggcagtcagatggaggtggggcgagtgctgagctcacccaaagaggatgcccattctgagaactgtttcaggagaaagaagcgcaaaaggccggggccgctgcctgtcccaccctgccgccagtgctgtgtgtcttgggtggctctatcacaggtcagcaaatttttctgtacagggccaaagagtaagtagtttaggcatttctgtttgtttgtttgtttgtttgtctctctttgctttacaattctttgaaaatataaaacccattcttagctcaagggcctataaaaacaggcagggactgtaattccctgacctttgtcaggcaccatcaagccacaggtaccctcctgatgaaaggagtaagagtccctgacaggtggtcctctgcatggggcggggggcacctggaaagggagggcctgggaaatgcactcatctgggagggagtctttccattcccactggctgagtcctcagttaccgcagggctgtcgagagtctgagacagaggtctgccctacaacattgtgctgagaagtaacgaactgagctgtacactgacacatttgtgaagagggaagatctcatattgtgtgtgtgtgtgtgtgtgtgtgtttaaccacaatcttaaaaaagaaagaaacaacaattttaacaattttaagagactttctcctcataaaaaagattaaaaacaagtgtgggaagatctggtaattcccaatagcgatttccaaaaccaaactagaggaacgactaaaatagcgttaactgtccctcagtcctcatcaacacatcctatacattaatgtattaacgtcataacaacccacgcaggaggcaccattattatcccattttacagaggaagaaactgaggaatagaaagtttaagtaagttgctcaggttatacagctaggaagtggctgagctggggactgagccaaggtatttttggctccagagtttatgttatggaaggagcctctgtaagatttggacaaaagggattttataaatgtccagatcattagctactctatcagttttcccactgtgattagcaaacaccatagggaaggtgtgggagggaggaactgagccccgtgcccaagccaggcttgggtgggcagaatcctgtgtgaagctgttgaatgggaacagatttcaacgcagaaggaaagcaggctgactctctggcacctgcatcaggaaagaaaggtacaggtagagaagctgcctatgactttcgagtcactgtccctccccgccccatcatttctggggaccagtctgcgactcaagaactgatttcacctgtgagcagggtgacttctggaggcaggtggtagtttaggaagttgcgggtttttgtgaacatgtaggtctcatttggacatctctcctaggaaagctcatctcctaggattcataaatcccccagtcagggagcctccttacctcaaatcaggcctttgctcttatgccatgaaaccaaccatgcatttaagatgaaaacctagagcaaagtcatccattagaatttggccacttttaataaatgacttgttaacatttatttcgggcataccaagaaaagttttttaattaaaaagcaagtcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggtgacagagctagactccgtctcaaaaaaaaaaaaaaaaaaaaaaaaaagcaagtcaaatgtttcctcatataagaactgaagtacttttcttttgtcttttaaaattatcattattcttatagcaacttggatctaaaaaacaagtcatgctccttgatgtaatttaaatacaaatgtttaaagtgctttccccactctgactgcagtcaaaatgtcaagccttatatttcacatgtctctccaaactttcaccttgcttcatgccattactatatacacgagtttttccctacaaaatggaatcatattattctatatcttgtttttataaaatgtaagaatatatagtaggcattttccctaatcaatacatatagattgatttcattttataaaaatagttacgccatactgaatactaggtatgcactataattaattcaacaatcctcctgctgatgaacatctaggttgctagaaaattataacaacagggggcctctctgtcttgtccctgattggttttgggacaattatctattcatttggagaatgacaaactagttccttacttcatactaatgacaaaaataattccagatagattatagacctactagaagaaaatgcaaagaaacttttgcataatcttaaaataaaaaaaggccttcttaatgtagactaactagaatctaccaaggaaaaagaacctgccaggtttgatgacataaaaatgaaactttctgtgtgactgaaagaactatatgaagtcaggacacttcatatccagatttaatttttctaatatgcaaagaggtcattgaaaataatattaaaagataaaagaaaaatggagcacaaaacagacttcacagaagaggcaatacaaatggaacaattattatacaaactagccatggacatgcaaattttaaaaacaatgagctactgttgctctcaattgggcaatatttttagaaaactgatagcatctaggccagcccttcccaatcgtctgcacctgggaatcgcctggggaccttcaagtaactactgatccccagctaccaatttaattggtttggggtatggcctggggttctacatttttaaaagtttcctgagagagtctaatgtacagactttgaacattaataatttgggaataagtcccgtaatttggaaaccactagtgtacattaaaggagggtatgaggcaaaggaggttttcatctctggtgtgggtgggagtgtaaatcatcacgacttttttagaaagcaaacgggcagaatttattaaaatttactaaaagaagaatgtacataccttttgattcagtaattccactttgaacaatacatcttggagaaataaaagcagcactatcaaaagatacacatgcatatacacgcaagagtgtctactgcagccgtgattcctaacaaaccctggaagaaaccagtggttgaaaaagagatactgagatctctaactcagtgaggatgatggcacaggtaccaatatgtctgtgggacatcgttaagtgaaaaatgcaagttacagaataataagaatagatccaattcttaaaaatgtatatgttgtttgcataagaaaatcaaaaggcctagaaaggtaacataaaagcgggagatgatgtagagagagtagataggaaacttagttttctgtgaaacacaagaggatcttttgtaatcaaaataattgacttttttttaacaattagcctttaaaatagacacatacacagcgagaaagaaatgaggcttttcctaagatgtattaaaacttgaagtaacaaatatactatattattagttatagtacatacttatatatttgtattatttatatctattttattttgtttttatattatacaaatatatacatcattataataaattatactacatactgctataattaaaacagtaatggccaggtagatctaaccattgactagagttcagaataaaaatccagatttatatggaaaccaattgttcggtgaagccaatatattttgagttagtggaggaggatggggaagcttgctgttactgcttgctatcatggccaactggagagagttaaagggcccaaagatggagaaatccagtgcaggtggtagcttggaagcccagccctagggctgaatgtggtgcattcttaacaggtttccaggtaatattgattctttgagccacaggtgagccaaacccactctgaaagccatggctacttacatccctacagtgtccactcaacctgtaaatcccacaaggaggtgtggggcaaggggtggacatggcctccactgggttcctgccaataaatggggtttggggttggctgcctggaattgctgtcgaagttggcagctgcttggcagctttgctttctgagcccaacaacagctccaagaatgtgtccggcaggatttaagcctgagctgggaacgcacatctgtgaggctctgatgtgaatattcagcagggagatctggatttcttctcgattgcctgtagcatcaaatctgtgacgaggcttacccaggactttcttctcctgacataattgcggttttcaaattcagttatgttcccactcttgtattaggtaacaggttaagcaaattcatgagcctgatttatttttctgtgaccttcatattttagaaagattatatccaagtcccaaccggcttcctcagctccctagattaaatgttctcattgttcagcttgtgttacagcacatcaccctgcttctcattaatcattcccaactgtccagcccccttagcttccttcggctgcagaaggctgcaccttgttcatgcacttattcatctgagtgagggttctctcccaaatttaggcctgtctgtggtagcctccagtggattcttggtgcatattttaaaacttcaagggacaggttagtgagaagctgggaattgaagaataaaagtccttcgctttcagtttcattatctttgggtgactttaggtatgacaatcagccacagttaccccagggtactactaaatctaaaattgagatgaccacactcagaaaaacacctgtttcctgaattaacttctcagtgttatacctaagtgaaaaattgcctccatgcttataaaccactccacctgcctccatttctgcagatggacattcatactcttcaaaaacacatcccactgtaacataaactgggtgaccaagaagctaaaagcagaggaatttgctcatagaaaatagagatctaacagctttaatctccctttcctcccctaaattagatattgtttctattaaattcccttctagtttcctcatttgccttcatcccatttcaggacataactggtgctgggaaatatggattcttctctatgtcaaaggcccactggtgactgcttttaatgagtcattaaacaagaacccacccaaatgcccatcaatgatagactggataaagaaaatgtggcatgaatacaccatggaatactatgcagccataaaaaagaatgagttcttgtcctttgcagggacacggatgaagaccatcatcctcagcaaactaacacaggaacagaaaaccaaacaccacacgttttcactcataagtgggagacgaacaatgagaacacatagacacagggaagggagcaccacacactggggcctgtcaggggggtaggaggtaaggggtggggggcaaggggagggagagcattagggcaaatacctaatgcatgcagggcttaaaacctagatgatgggttgataggtgcagcaaaccaccatggcacatgtatacctgtgtaacaaacctgcacgttcagtacatgtatcccagaacctaaagtaaaataaaaaataaaaataaaacaaacaaacacaagaacttctgaggtcctccccgagaggactccccgagggagcttggagcagttcctgccacatagtgggcattcagtgaactacttgagagattaatgtctgttgctctccccaggcacttctggacctatctggtacacactcaggatatttcaatttctccacaatcccctgtgaaggtttggcgatggtgctggtgaattggttgcaccgaacaaggaacctgtccactgggctgctttcaggcagcccagaccagccctgggaggcccggcttttctggacacgattagctttcataaatcatctctctccactattctttgctttacgatcttttatgtggtttgtcaattaagttttgtagctataatgtcttaatatttggccctggggtgtaggctatcaatcaatctactctaacctgcatttttatagtaaatctcaggcctcggcatgttgaatttcccatctgggccttcagaagtcttctcttctcacttcttacaaaaacaagagaagctactgtgggtccattttccaggagggacattcctgctcctcagccatcatttcccaaaaaatcctttcatttctcccgggatttcttattaagttactacttttagattctaatgccttatttttccatgttagctatattggattctttgttcacttttctaatatttcccatttgcttgtgcaaatctccttaccaccatgttattaacccttcccttcccatccttcctggtcagtggatggtctctttatgcccttcctcacccagcactcacttgggacaccattccctctctccaggccacagcagggctcctgactgtcctcactgcagaaatggaagcttcttcagcagccatcagtgtccttttatctccttactattctttaaaccatcccacatcccttccatgaagctttttctctctgttgccagagcaaccgctgggtgcgggtgaggatgctcatggccccatacccatctccccatcatctgcgtctggcgtggcccttgctaaattggccaatcaatcatctggggaagagccacgacctcatgggttcaatgtttgcactcaccagggttccctacttcttcgaaggttctgttgtttaaatcttcaaaaatgtaatggaaatggatgttctacacccctttgggggtttcacagggttttgagaaaggcacagatggaatgtatgctaagatttttcttaattgaaaccaaatgtttttctcagcaacatttgccatttgattcttcagtgatgggagatgcctaggaggaagtcagttgacagtgatgtggagaagaaatgcttctgaagtctctttgcgcttgccttttccacgatgacactcttcattgtgtgggatttccataccccctgaagggcaaaactgctctggagggaggacttctccttccagatatcgggaggagtgacaggaaagtgagggaagagcgaggcctgaagagtgctccatctcagatgagggtgcagggcacccttcaacgccaatggccaccgctgctcacagcctctccagaagcgggaagatgggacactttaaccacgaggtggtcttctctataaaataacagtgggcggggggagatccatcgtgttccctgtggaacacgatgggttcatgggccataagatacagacaatctgacggcaagaagccgagtagtagagagaagtcttaaatacagtgtgaaagtgatcaggaaatttttcaagaaggaggtggcttgtgagctgagtcctgtggggcaggcaaggaggaatgaagttaaggaagcagagggcagtgcttttcagcagttaggaggaataaagtctcctcaggcatctctttaaaatgccggctcccaggccccatcccagaggttgaactaggaggtctgaagcaagcccgggacttggaaaatctagcaaaccccaggaaccctagttgagatggactcagactacctgcattatggaaagcacagacggcagtttcaggcaaggtgaagggcctcagtttggtttaaatactcaatttagagcaggatttgtaaacttaaatacctctggggctagggtgacacagaccttgagagaagttgaaggtttacaagtacaaagaggagatactctctctctctcccccaattctggaagggacagcagccaacaagctccggcaattactgccatgcaggaatatgtgctccggactagggcaccagagctgtctaccagaagagaagccagagacctgagttttatgtgccccagaattattaaatgatacattaaaatgccacgagcatcacataattccatgaagtccactatagtaggcaagttcagaggagcaaaataaaatctcattgcatatggacttaaatgatagaagaaaactgtattttatccggtagacaatgaacaatagaaggctttgcagcaaagaaggaatctgaacagaagtgtgctttaagaagatttctgtggctgttgtctgctcgcaatggaatggagaagggacctcagatatcagctcctaggaagcctctcccatgtgcaaaaggaatggagaatagaggatgaaaggtttccggaaacaagaattcaggagatttgattgactatggaaggaagagaaaaaaaggaatcacctggggtcttctatgtctaaatccatgctgcctcttgccatccttttcctttaatatacactaatgttccagcttcattcattgcacagaaaaatgatcatttaggttgcattctgatcagtgcctgcttaataatgaaacttagagttatttgtttaggaaaaaaaaagcacagacaaactattttataatatctataataaatgcaaagaaatcaatacaaacaaaacttggctttagcaaactgtacatacataaatatctttttttttttactataacattcaacttttttcacataaagccttccatgatcttatttattacatctagtttttctttatacctctaaaaaaaagtgccttttagatttacagcttgtgcttctaaagcaaaggttaaaacatcatgccccaaaggaaaacaaggtaaaaaggaagctgccatataagctcttaaaaattgtatgttacaaggttctaaaatctcttcagcactggttggttggtagattgtacgacactgacatggtgcttgggagggtcatttatctgatggttggagcagcaccatgggaaagctgcccagatggtctactgaagtccttggctgtgcacagaatgggccaagggcccagaattcatgagtccggggaactttggaggtccttactcaatctccttagtgctaaggttcagagtctcaaaccagatttcttccaaaccttcttgttgtctgtttgttcccccgtcactgtttatcttccacctctgaagccataatttgcacacatgtgatctggaggagggctaaagctgccacaccgagggctttcgccaagatcaaggtcctcttgttggtagtttgggattgcttatgacccgatcctccttatgctaccagcacttctgcagatggcatctgcttagttcagagtggaggagggccattcgtgtatctgagcatggggtggaatgaccgggcaaagttgttggagagggcacagctgtagtcttcctctgacattggtacaaggcaggcaagcccgatgaggaggagcaggagaagctgaaggggaagagctgctcggaggactctgaacaggaagccgcggccggaccgacctggccctggctcagaaagggaggaatcggagccaccttttgtggacctgagagaagaatggacataaattactcagataactccagtgtcggagggacgctgctttttgcctctgcaccttcctggaagctaaagggccatgccaagcacaccccagcctggcgatcagctgccagccttccacagtgtgcccaggtcaccccccaccatcaaatgaggttgttggaaactgcactgacaagaaataaacatttagtcagtcaactaaacgtaagtaattaggttcaaattctactccttttaccccttaatgtggtgaaacattttctatcaacgaaaataactgctctatacacattctactagcatgaattaagtagatccagaataattaaaatgtagatatttgatgcagcatatttttgttttaagaatatcatgaacattgttaagcaaaattagttgctgtcagaatcataccaagtatcccatctagccatcctggatatgccaaaatccatgcagcaaaaataaaaacagtctttgtcattttgcacagacccataaaagcttcattaatcatagagcataccctggtttcatcttgcactgaatcagcatcaggccctgacattagcgggttccaaagctgtacgaacaaggaatagcagtggagtctgtctacagaacactggtgttgtatgatgtagatgctaggctgatcctatcactgacgtcattactttggaaaatggacaccattttctgaggaggatggactgtcatcctacagccccttctacactcaaagtgacaagtttttctatttcacttttatcttccttttaaacagtgcattagagattgagtacaggtttcagaactcttaagaaggactgcctggaaaatacagaatctggaagtagattctgagttgggtgctactgttttctttttgtgaacagccattacctttttttggttactagcagaaaagatgaagaaagaaatgttgtttacgacaggcatttggtgtacactcagacccatacaacattgaatgaacaaaaataaaagatgtagccaaaagaaacactccctcacaactagtataaattccttaagagttttaatatcaccaaggataaggacattgtatgtgaggctactgaaataatatgagcgtgtgaaagctgtattggtaactgtaggtttggtccagaagaaagcactatgtttgtagctcacctattacctattaatttctgaagacagactaccctaatatcggtgggggaagcggagtgacacctaagaaaataaatgttaaaaacagatagaatccccttagaagggaacagagggagtattcaaaactcttttattaaaccatcaaagaaaaatgggagagggctgggcacagtggctcccgcctgtaatcccagcgctttgggaggctgaggttggcggatcacttgaggccaggagttcaagccagcctggccaacatggtaaaaatacaaaaattagtcaggcctggtggcgtgtgcctgtagtcccagtcacttgggaggctgaggcaggagaatcgcttgaacccgggaggcggaggctgcagtgagccatgatcggaacaccactgcactccatcctgggcaacagagcgagactctatctcaaaaacagatattggttctgcagaaaccccaagaaacaggcagcacgcagtgtttctatacacttcttgtggtgtaaggaaaaatcaaatcactggtttaaattggaagcatgttcttttctgaaatccacacaagtaacggcagggtaatgtaaccttgaacaactcacttcatctctaggtgtcaacctcttcactaacctcttcaaattagcatagatggtcttctaactttaaagtttactgttcgatgtttttgtcttctactgatttgtcagtataaataatctcccaagaagccacaagagctcaatcaccatctagtggtcaaactgattaactgcccttgtgctaagaccaatgagttattcctaataagctgagggaaaaaaaagtatattttgtgaaaatatagtagaacataaaagaagtatgtcatataccttattaatggaaaaggaaaatagaaacttcttgagttacctgagcataaaatattcatgttgagacagggccttagagagcatccagttcatctcctaattttgtaggggagtagctaaggacagttcatgtttactcttctaattgctaggcagcactctgagcatttatgttgggttctgtcatttaatccccacagcagtcctctgcggtgtgtacttattaacttcattttacagatgatgtgaaagaaagctcagggaagtgaaataactggctcaagctcacacagccagtggcagaagatttcaaccctgtgattttaactaccagaacctggagactctagacaggctgaatgacttgcttcagattctacagttaaaggaagaggcctagcagggactcaggcttccaaaatccctgcccaccgcactctctgctgtgaaatgttttgctggttggtgataggaataatggtaatggtaattcaggtcgtattcatttcacaggtatctcacatgtagaagcaaagaagagaatcctgaacttgcatcctaaaatatttggaaacaagtggtttcctcgtgtctaaagcctctggtcataaggcctcacagtatcctgcagatcatcaaatccgtgtgtggacgtggggacattttgttttgaggcagttacatgaccatgggcaagtaaattagtctctctggccttcagttttctcatttgcaatgattcaatggtttgccttaaagtgtcttaagaaggataggatagctacccacaaactttggatcaaattttcttcaaaacatccttcccctgactttaaaatatgccctggcaaccaacactcaacacctgtagctagatgagttataacagagtgactgaagagagctcccacaattcctagttattaaatacctgactaattttcattaggagacatttaagaactttagtgatgggaagatttacatatataattgatagtacaatctgacagagctgaatagctcctgtttgtcaactgttaaattctttgtgcaattaggtcaaagatcaagatcaaaacaagggctgcccattgacctgttcactcctgagaaaaatggcaaaccattgaatcataaatcatgacagccaaaataattttaggatattaatgcacccctcatctttgcaaatgagaaaactgaaggccggagagactaatttacttgcccatttttgataaaaatgtcaccatttacagaatgtggactcctatgttggagtctgttgaaggacatggcacatttaacagcatcagagcattttttattaaaatttaatttgtgcatgacttctaatgctgaagaacgccaagctaggaagaagtcatgggctgagatggggacagagagaacacacaatattcagtgaccgtccgtgcagctggctgcccttgaaaatatccgaactatccactgggaaaatgcctgtccccttggggtaattaccagagtttcaacatgcccaaagctgcctcatcttcagggggaacttgttctagcgattttagtatcaagaagctaatggtcccagggaaagggttatttttaatatttagctactgtgctaaaaatcacctaagtttctagagtcttgggaaatttcataagggaaagaacaaaggcaacttgttgactacccactggtcattctcctctggtcttattacatacatggatgccagtttagattgtgtttatataggaaaaattaaatgtgtgagcctccttaaggaacatcatcaatacagatatatcagatagttctgtccagcaaaaaacgtgcttatttgctacaagtaaatttttatttatttttctcacttccctcactccttcaaatttccaggtaaatagctgcccaggagttgcttcatctctgtcccaaaatacctagacaattgcgggataaggagaatggcagggagggagtagtggctaaaatcacacccttcaaaagaaagtgtgtaggacacacaattgtgagaagtctgaatgccatgcacatagggtatgactcactttgaaaattgtttataatcaaggaaatgaaaatgagttaatttcgtgcatgcatcatttaaagccaaatgagaagaaacttctaatttattttgttacttttcggctaacactggcagtatgtaacagatttattttgcagaaacatctagattgtccgtgatcttgatcctgcccttatgtgtcttgtctttgaaacccagtgtttcctggatatatggttcaggagacaagtttccagaatcaagttaggacccaggtcttctttttttccaaaccaaacattcttgctaatcctaaactacctgaggcagcctgtggtggcctcagctctaaaaccattgtttaaaggcttctacccatcaatggcccttcagcagagtggtacggttaacggggtagggtctggagtcaggggagacctgggttcaaatcctacatctttacacctctaatccccagtgtccttgtctataaattgggaatatagccatgtcatgggattcttgtgagggttaaatgaggtaaaacacatacaatgcttagcatgtatacaattaagcactaaataattgaaacacattaagtactaaatgaatgtcagcagcttatcactattatctgtataatgataccaagggtgtgccgactcatacccttaggggttggctggattcggccttttctctcgggaaaacatacctgatttattaatagtgctttcaagcatgtgataaatttctcaaactgcctgtcttgttccctagaaacaccaggaaggcctacctcaaatagcaacagagaaacctatcggagccttaccctacagctttccttggggcacgggtgagcaatctgccttagaggggagaggctctgtgctgaggctctttgaatgctttgaataaatagatccccagataatgaaaagacttcaaaacaaattctacaagaaactgagtagtgtttatagtgaggccctagtgtacatgcaaaaaacccccactgcccttgcttaaatgtatctgattaacttgaatacatttttaaatgagggcttttttccctctttcagtgtttcggccagtcatttgccacttctcattccatcttagttctctgtaaagaaggtgccagagacctaaggtgcccaaggcaattttgcattttacaattctaagctttagaatgaagtcatcaatttgctacatccggactacagtgcaattattcctttgccttgctggaaattggagtgaaatctttctagctgtcaatttcaactcagttgcagtagtgttttgaagaattaatggcgataaggttagaaaattttaagtcaaacgtagggaaaaagtaccagctagaccatcataagcatttgctttgaaagcatgcttctaaagtgtgtttaacctcaaataacagtcacaaatatggttattatgaatgtatgcacagatttttatgtttctaattttaagaagttctagggagctccctgtaacgatttagggaatctctagattctgatatactgcaagtcttttaatggtaggaatcacattgaattaattttgtaggcccagggcctaaatttagtaggtgttcagtacctattggcatcaattcatatgtaggtttaaaatactgtatgaagatacagaatcaccaccatcaaatcaaattgaaatatgtaacaggctagtataatattaacatctgactttaaacaacaacaaagaaaccaaatgagtaactcctcccttcaaactaatagtcagtttcttccaactcagtctctttctcctctcaggaagaatgcgtatctaaaaatttcccattgcagactgctggaaacaacattctaaactatttatgcttctgcaataacctttccaatttgctggaccagtgcaagattaaacacgagatatctcaagtctcaatgtaaaggaacaccacgacagcctggactgtgggtgaagttcattcttccccagcagactctgcctttcattctcggggttgggtgtgccccaaacagaggtaccgacggtaacgaagcccaagaatgttcaaccacaacctgtctgtgaaggtgttggatgacgtttgccattcaggtgaagattatttatgttccagtcccacctgagtagcaaagtgaacactgtgctgaatgctcagaaagatgttaatgaaccgtgctggacagagcagagctgaaaggcgccttgcgagtgtcgtagtgagaatgtggctgtcccagctgcaaagccctgttaggaggcatgaggaagcacttgctgccctaagaaacgatgccttcgacattttcaaaagatctatgtggctgtctgaaacaatgcggagagcagatagacgcaatatttgggaaccaaagagtgactgctgttggcgttgcatcataacataagcgctttcccccttctcgtcactatcatttgtatcaaccaaagaactgatctctggtatcttcgaaggaatgctgtggggatattcttcatctctgttcatggtacatcagcaatttgtggggaaaagatggactatataacacaatgatctgcctaaaagaaactgtctctacttatagggggctgagcaaaccttagagcatctgcggatgctcgtcattatcttcaaaagtccccaagagtttttctccatactttattattgctattttgtttaggctagaaaaaaaaaactcataaaattgtcttcaaaccaaaccaaaggaaatgaaaagaaaaaaaaaaacagtacagggaggtctaaaaccagagaacatatgaaaatacgttctgcctgacttcagccgagtgggaaggaccaaatgaaatagccagtcccttatgtacagctggaaaactaaaattattactcaagggttgtttacagttctacatttcctcatccccaccctccttccaggaattcagattcctgctcagtggtgataagtttccagagggacaagctactttaacagtgaattgctagggactggaatgaaaacaggctccgaggacagtgttttcattttttagaaagctgtctggggaaacttgaactgatcagtggaggagcagaggagcacagacaccacaccgacaacaaagaaggcaaagcactgctaactgcgggagtgaggggctgctggaggccaggcaggaagcgcggagtggcagctgtgagtcggctctcgggaggtgactgggcaggggcactggctgctgcgggttccagagtgagcttgccaagtgcccggaaagtgagtggctgggtgtgctggatgaagggaagttttaggataagcagaagagagaaggtacttataaatttccaatgaacaccaaattaggacttgccattttgagactccaaaacccacaatctggataaaacatgaaaataaaataaaaagttggggatgttagtatattttattcagatatgcgggttttgtgaatggtaaaagaattcactgatcgattacctgtcttattgtaaactctagaaataaagaggatgataaaagtctgccatgaatcaaatggcagtggtgccaccaattgtaatcaaatccttattgacaatttgatgaaaagtaccagatgggctatgttgagacaaacagaattttcacggagtccaaatattttatgctctgaaatttacttgaacatttcattcagaaacttctcttccaatgtatgaggaaagggtgtggactgaaatgagtaatttcccaactaccctgaggcagaccagatataggtcaacctaagtcatggacaattttcatcatcctcttggggttctagaacagtgtggaaaccaggagaaggaggtacctgctatgtggactgctgacagagggtccaggctgtgagagactacacttgcctcgtggctgtttgcaatgaacagggggtaaagaaagaagaatgttcagtccaggcaaataaagacaagctactaatgaaaattaaactaaaagtgcagcaaaggaaaaataaatcaaatgaaatgatcagtacccatgaattaaggaaactggcttttcttttgttgaagaagtaaaataaatttatatctatgtgattagccactgataaaacattaagttgggattctggagtccatactatggtgggcataattctcatggcttttcatggtagaaacacatgtgtatatttacatacaataaatgtaaaatgcactatgccatatcacatatttcaaagacacttaatatattttttttcatcttttagaatagtaaaacagtgttaaaattcttggcccataagaaataacaatggcaatatgagattggtctttgtagtgatgaagcccaacttaaatattcaacttaaagaaaggttaaaatttgacttgaaaagccagtattccttcacattcttaaactaggatctataggaaactagtgaatgtagtaaaaaaaaaaaaaaatcctaaaaaagataatacatttatcagcatagaacataaatgtttataacaaaaaagtcaaatgaaatcaaaacttctaaaaactaaggaaaaatggaatgaatataatcataaagctggacaaaaaatatataacaaaacaaaaaacaagcttctaattacacagagaaatcaaggcatagagggtagcaggggccgaatttgtcctttcatcctctttgtgttcagtgaggcagcccccgccaaggcctgtgggtgagttgttgccattttaggggtggcacaactgccgcaaaccttcaggaccaccacccagaagcggcttagcttgagagtcaacagaacctccacttgccttaacgagtcaatggctcacaggcgttcacggttctgtgcacctccagccgaggcgccccgcaagtggaggcctaccttttaagatagtcgtggcagccatggcttgaagaaaggagccaccaaagggacaaatgggcaccattctggaaattttcttatttgagcaagaaaaataaatgttctccctgcataccagccacacgttgagtcctgattcttttgaaaaccagaatcgctcttttccattcctgagcgcatgctgggaggggatgtggcagggctgaggaagcgcgctaccctgtgtgacagccctcctctggaggggacgcctgcctgtgaaccctgtggtgggtgcaaatactgtcacttcccagtgttcactcccatgggccaactgaaaacgaccagtggaaagttaccgttttctgtctgtttggggtgctccttcctgatgtgggactcacagaccctgaggtgtccagttcatcagcagaagaccaggaagacaaatcctatgtgggagaaagattcttttaacaactccatgtcccagacccatgggggccctctgttgcaccacgttatctcccactccatctccatccacccccatgtctccaccataaaaatcaaaccattccttggggaaaatggaaccagacaggtacaagaatagggccaaattcttctagtgtgttgggatttcctagctgtccgtttggccgttctggaaaatatagctatgattttgttattgctatgtttcacttatagctttattatttcttggagacatggatatgaatgaattgatattggcttgggaggggaagacacctgctgtagagcctgctggtcactcaggctgaacagaagtcaatacattccagttggaaacaaaagatagtcatctaggagtctgcctttttgcattagaggactttactatttcagacactgctgctattcagagtagattgttcttttgcatgcttacagcagggcaaagcatgtgttcatggcaggatttcacagcagaatggttgaaatcttaccaggcatcaccacatctcacctgcaaatgcatttctcaaaaccaataataccacaatggagttgattgtagaaaaaaaaatataaaaaattaaatgagcagaggactgttttttaatttttttttttttttctgtatacataatggagaattcatgcctgagagtggttaaatacaaaactcagatacaacaattggtttgctctaccatggctgtgtaattaaagtgtgtaaattcttaaacagggtgaaataaaatgccacagcagttgtggtaatagcattagtagcaacaacaagagagcttttggatttaacagaatcaaaagcagtgtcctgttgtaaaagtttatgtggctgcttttttattttgagacaggacttgtaagagcagtggctgaaaggagacactccattctgacaagtactatatttaaagtctttctaaaatgcatgaagatgatgcttctttggtctccagtaagaaatgctacacgatgatgtctgtttattgcttacctgctgactacttgacacgtctaataacttctccagttccttgatatgacgactgacctccttcaagagaagtttgagccgatttccaataacatggactttttctttggcttctaaacagtctgttccttcagcattcaccagtagttggcaagacatgtcttgcaaagaggctactctgagttgggattccaacagctcatgctttatttgctatgcatacaaaaacaaattaatttttctaagcatttttgataattggcaaaagctccaaaagtgcagaatgcaatcaacttaacttggtgggaaattatacctgagcatcaaacgtggagctcacacactaaaggatgcagcagctcacggcctgagttctaatcctgcctctgccaaaaatattctataagacccctgaccgtctctgatctcagtttgatttgatgcctggtccacagtattattggaaggttcaaattagttaatgtatatatgacagtaattaaaatatagattagtatgcaagtgagatgtaagataatcttttaaacagaaaagcacaacattaaatatagcgaagcagaagtatgtctaggtatcctctgatatctagtcaagatttgaaaaaaaaaaggggtgattcgtcattcacagcttgatgccagaggtcaaagtgaagtaaaaatgcagttccacagctatttcctctaggtttctaagactattatggtactgaattaaaaggtaccaattctgtagtttaggtgagtgttaaatgttaagacataacattttaaaaatacagagagctacaaagtgcataatattttcttctaatggaactcaaatatgcttccttatcttctataaagtcacttaaatatactgtacattatattgtccaaagatccttgtataagagtctaccagttaatttcctcttgaatttagtgctagaaaaagtttctccttccttgagaagtggtatgttttgtttttgccagataatgaaagtaagtttactccttgtttcccattttgtcttggctttcagaaaacttgatgctcaggttcatgtttaatctgatgtatttaattcctctttgaaagactcggctgggtgtggtggctcatgcctgtaatcccagcactttgggaggctgaggcaggtggatcacctgcggccaggagttcgagaccagcctggccaacatggtgaaaccctgtctctactaaaaatacaaacattagcgaggcgtggtggcttacacctgtagtcccacctactcgggagggtgaggcaggagaattggcaggagaattgctcgaatcccggaggcggagattgcagtgagccgagatcgcaccactgcactccaccctgggcaacagagtgagactctgtctcaaaaaacaacgacaacaaaaacaaacaaaagacttaattgtctcattctattctaatattttaatgaccttttactacaagccaccaaatatacttttgggccatagatgtaacatgaagtttaaattaagctgccttaataaacaacacaagctaattaagattgcttgagaacactaagatttttacaactgagcaacaactttagaatcagattctaaagctagcagatatcatcttctatgcacatgtttgctttacaaagattggaaaccacagggagttaaaaaagtgtaaagtagagactataatgcaaaaagttaaaaaaaaagaaacaacacttaccacttatattcattttctgtaaatgaaatgcaaccctgctaaaaataactggaggctgccagagttcacacatcttaccataagctgtttgtgatggtcctgaagtatctctgcatcaaggttagaatcaatagggacaatttcatttttccttctgtcaatgttctccagcataagaagcaaaccatggctcatttcatggaaaccctacagaaaacagtttaaagtaactgtaaataaaatatttttatttctctcaaaacttaaatgtctttcaactgccaccattagcaaacatacttggttttaagaacgtacatgcaactcctttctgaggaaggcactggtgctgttgtaatgacctgatcgtgagttcacgttcttaccaaaagcatctaatttattacttggaggacaatttagacgaaaggaaaactggcatcaacatacgttatttctgaaaaaagggtagtgctattatacagtttggaaggaagcaactctgctgccctctcttctctgtgtagtcaaatctttccatattttaaggcccacctaggctgaatctcatatccccttcattcattcatttattcactcattcattcatccatttatttattcaacatacagttactaaagatctcctacagataaggcactgtactaggagtgggtgcagaggtgaaacagcagtttaggtacccgctttcaaggaactattatattactcttggggcacatataaacctggagagcaggcttcaactccttccagggctttccatggcgctcagaatatgatccaatctcctggcctggacctacaaagccatctggttcctgaccacctcctcagtctttcttatcactccctggctcagctcaccgactacactctggtcacaatggcctgttttctgttcctaaagacactaagtcctttcctgcttctgggactttccatttattatattaccttcatagcaacatccttccaatgttagctcaaagagccaaataaattccctgactaccctctcaaagtggcttttctcagttacttttatcatccacgtctgcaagtatctggtttaactatttgcttgcattttattgatcttgtcttccccaacaaaagcagaggccatgctgtattcaatgttttagcaccacgtctgccatatggtggacgcccagcaagtaattacagtatgaatggaaaaacaaatatttgcaatgctcactttgatgttcaagaagggtctgcctacttgcccagtaaatatctgttgaataaataaaggaaataaatgaatgagtcatagaaggagcgttgcgacggagataaacatgaggaatagtctcttcttatctggacagaagataggacctagagattttgaacatgatcatgaacatgtagaaatgctccagtaaaatgaaaagtttgggcacaaggttatctcactgaaatactgactttggggagcaactgcgtccctctagaaaccatgatacatcaagtcacacactcagctaaattgctaatgtctctctctgagtcacctcctgcccaaagctctacagacctggcactgcatcagggcatcctgcagcaggccccgccactcctccagcagagagcacactcggtcccagcgcccattcatctgcgacaagcgatcctgcaggtcccggctctccttgctgtcagcctgggtgaactcagggctgcagagattgatggagaggatgatggctttgcggtggtccacagctttctggagctcctgaaaagaacaaaaaagacaatcaaacaaggacaataatgacaaagatattttcccttgaaaatgtttcacatgaatgaaaagatccattaatttaaactggccttaacaggatggctaggtaaaagacagagggtgcgtaccactgagaactgtatggcagttggaagaaatgaattagatgagtacttaacaacatggatgaatcttaagaaaacagggtgtagagtgaaaacgtcagaaacagaatgttacatggaacacaacagcctcaatacattcacacacacaaatccacatttttaaagaatatatctgaacaaagaaggtctgccacatatttcagaatagctaccattttgaaaatcaaatgggaacttagagttcagccagggtagggggtgcaggggggaggaataaagaggagtcttgtaggaggcaacaataacgctaggcaatgacctcattaaggagtatgattgagtccacactctgtacagaggttcaaccacaacaaaattcaaatttgtgggcctaaaaatgaagcaaagaaaacagatgccagggccctgggatccagatgtactgagtctgcaggctcagtggcccacaggctgagaatactgcctgtgccacactgatgtgaaggtagagagaatgaattgggtatttcatgagctaaccagttaggtttgatttcacaaaaaccaggtgactgatttttggctttgtgcatttccaaaacacccagtgctcaattccaagaacttgagcacaggagtctgtattagtaattgagtatctaggtactgtttaaaatcccccaatccagttagggtgagagatcctggaagtcacattgacctaggctgcattttgaaatcatttctcactagccctgcaatgttcccaatctgtcttgattttgcacttttcaataggttcttaacatactgtagaatagattcaaccacacagacaacatgggtttaagagacactgtggaaaatacttgattattccacagatttattcagagaaaatacagacaggaagcatcaggagaaagtacaaaggaggatgtcttttttcttgtcatgccggatgactttcaaggtcttatttccctaccctaatctctctgaggtctcagaccctggccagcatttgcttcatcaactttttaaggaatctggttataatgcaacatggccttactagagtaatttagggactctagataaaaatgcatttcataatgcagccattgtaaatctctctcacgtggtactttgtcctgaaattcatggggtagtgtagaggcctttctatagggatgcaccttttggatcacctggaggggagattcatttctcttgtttgaagttttctgtttgaaaatttaaaacagaccaggcgcaatggctcatgcttgtaatcccagcaatttgggaggccgaggcgggcggatcacttgaggtcaggaattcgagaccagcctggccaacatggcaaaaccctgtctctactaaaaatacaataaatagccgggcatggtggtgcatgcctgtagtcccagctactcaggaggccgaggcaggagaaacgcttgaacccaggagacggaggttacagtgagccaagatcgcaccactgcactctagcctgggtgatagagtgagactctgtctcaaaaataaataaataaataaataaataaataaataaataaataaataaaataaaacaaaatcacacaatcactaaaagcaagccaaaaaacatcaaccccaaataaaaagcatatactaaaaccacagaaacacaaaagcagcacacacttcattccttatcctgaccccggagagcctaggtggccacattttgaggaggagcacatcttaatactgtccaaacaggaaaaaacaagcactgatgggttttaaaaagaaactgagctctcagttcatgagatgctcacaatagtctccatatattaaagcattttagtgtctgggttaaggaggattttaagatctagagctggagttaaggtgtactatatccatgcgggccaagccaaaatcaaacgcaaatgccaggtgtttcaccacaattactctatagttttatttattacagcaaaaattgcttctaccactactgtaatcaatttcagaagtttcacttacttgaggtcaaataacttcattatgtcccccacaaattcatgcagatacaattttggagaggatttctctccagctctagatataggcctgtaggagcctggtcattctgtatttcccttacaaagaattctcgtaggtcccagaagtacctggatgcttcatgaaattttaattggacatttcttaaaatatcaattcattaaatcgtgtgtgcttatttacatggtggatagttctacaatatggtccccttttctgcccttgaaaaccatctttgtggccgggcacggtggctcatgcctgtaatcccaacactttgggaggctgaggtgggtggatcacctggggttaggagttcgagaccagcctgggcaacacggcaaaaccccatctctactaaaaatacaaaaactagccaggcatggtggtgcgtgcctgtaatcccagctactagtggggctgaggcaggaggatggcttaaacctgggaggcagaggttgcactgagctgagatcatgccactgcactccagcctgggcaacggagtgagactccatcaaaaaaaaaaaaaagaaaggaaggaaggaagggagggaggggggagagaggaaggaaggaaggaaagaaggagaaagaaagaaaaaaaagaaggaaggaaggaatgagagagaaagaaagaaaaagaaagagaaaaagaaaagaaagaaaaagaaagaaagaaaaagaaagaaagaaagaaagaaagaaagaaagaaagaaagaaagaaggaaagaaagaaagaaagaaagaaagaaagaaagaaagaaagaaaagaaaaaaaagaaaaccatctttgtggaatacaggaatttgggatggctggaggtgaggagagcattctcactcatttttgttagatcccttttctgctgctgtgtaagagcagctcgaactagaggtgccatctgcacggtcgttcacgcggtggctctctgtttgtccgccgtgggaaaggcaaggggcagctaccttgagctttttgatctggagctcgatggtctggatgtcagtgctgagttccagacgctggagctgttccaactcctcctccgtgtcccccagccaggcccagatgctgttcaagtctgagttaaactgctgccacttctggaggttctgcttcatcctcaactccttgctcaatgcctgggcctggagaagctcccatcggtcaatcacacctggcaagacatgcatagaacagtgaggttattttcctctacatgtgatgtttatgaaatgctttaaacataggttggcagccaattttaaatagcaacagaaagaaaagtaattccactgggcattttcgttgttgtcatctggaaataacagttacatgggtacaatggctgtgttttttctatttgtatttctaataataatgaagcaaaaaagttagttacatgggcattcacactgtaaagagctttacgaagtaataagcagtcatgagcacgaacgatcgttcaattcttggatcctgtctacaatagggctctgagcacacacatataaaatgcctgattagatatgtgagaaacagtgcattaaaataattggaacatgagagctggggtggtagtgcgcgcctgtaatcccagctactcgaggggaggcgggaggattacttgagcccaggagttggagtctagtttgggcaacacagcgagacttcatctcaatattaaaaataataataataaatgaaacatgggcaaacactaccatgatggcatgcatcatcccctcactgtcaaaggagactgttggccaggtgtggtggctcacgcctgtaatcccagcactttgggaggccgaggcgggtggatcacgaggtcaggagatggagaccatcctggctaacacggtgaaaccccacctctactaaaaatacaaaaaaatttagctgggcgtggtggcgggcgcctgtagtcccagctactcgggaggctgaggcgggagaatgccatgaacctgggaggcggaacttgcagtgagccgagatagcgccactgcactccagcctgggcgacagagcgccactccgcctcaaaaaacaaacaaacaacaaaaaaggagactgttataacttggaaggaagttctcaggatagaacggtgtagaagaaggccaagccccctaagtggaatttcgctgttaacaaagtgcttcaggatcttctatttcattcactcttgaactggatgctacgcactcaccagccgtttgggtttcggtactatgcaggttaacaaagccaggaaggctctcctcttcctccttcagtttgtgctccagtctcttcacggagtctatactgctactgcattcgcccagcagtttcatctgtttagacataaacaaccggcccctgtcacccaaatcttcatgagtgcaaaagcttccggggaaaatctctttgtaatttctcagcaagagaagtgtctgtgtttggctcctctgtgccaccctgctaaaaataagccaagatggccgagtgtggtgtctcaggcctgtgatcccagcactttgggaggccgaggaagatggattgtttgaactcaggagtttgagaccaggctggggaacatggcaaaactctgtctctacaaaatatacaagaaatttagctgggcatggtggcatgcatctgtagtctcagctacctgggaggctgaggtggatcacctgagctcagagggtggaggctacagtgaaccataattgtgttactgcactccagcctatgcgacagagtgagacccagtctcaaaaaaaagaaaaaagaaaaaataagcagaggtaggctgggcacggtggctcctgcctctaatcccagcactttgggggccgaggtgggaggatcagttgagcctaggagtttgagaccagcctgggcaacatagcaagaccctgtctctataaaatattttaaaaatgagccaggcgtggtggtgagcacctgtagtctcagctgttcagggcactaaggtgagaaggttgcttgagcccaggaattcagctgcatgcagcgagctaagaccatgacaccgcactcaagcctgggtgacagagtgtgagaccctgtctcttaaaaaaaaaaaattaaataagcaaagttcaaaaacatgccttttaaacaggtgatacattcacatatacaaaaaacaatgccttaaagatatactttgcatacatgattttgcacgagaagtccttcaagtttctttacgattcatgactcaaaacagattaaaccaatctgcaatttaaaactcggagccctcagctggcaatgcagtatataatttttggcaagctgctccctctttctctttcttaaattgaaatgtgggaacgttaatgttacgacaaatctcatgggaactttcttgcattaaataattaaaatacttaaaattatagagcaatattaaagccagctgttttataaaaaaaatgtaagcaatgtttaataggcatcaagggactaaattctaaagtcaaagaaaagcttccaaattcatttttaatatcacatacagtattcaaagattaaaagaacaaatcatttcaagatactcctgctgtgcttaccataaatcctttaacaaatcacaatgccagtaggactgttattctgattacttttgattgaggttaagtgtaatcccagtgatgtcagtatgattaccataaaactatatcataggtatttttaaaaagtggtttcactataatagaagttggtataataggccaaactgaacaggaaacaaactcataattgaccgctcttctgtaattataaggataataaaatcaacatatatagctagaacagttttctttcctaatttcaaagagtagaacatgtgagttgtgaccagacttggggaaattcatttttctttccttgtactaaccagtcttttggatatgaaagaagacgtgaggcagagaagagactggctttaaaattctcttccttaagtacgcgtaggaaagcaggtagttctctagggaaaattaactggtcagtaactcgagtagggcaaataaccctctgctagactttatcatacatagccaatagccgcatagatagaactggtagtatatccaatgccttgctatcttttccccaaatccctcttgctagaactgttttcttcagaatgagcacactaaaaaacagaagagaaaaacattcccaaggtcattcggtgaacccaggaaaagaactaccaaaaaaactgcatgttagtaatctattagctaaaatctgctgctccaaggataaccttggtccaaaaattattagttgaatttggaaaaatgcctaatgacttttgggagccaaagtattttgttgctctcaatgaaaaggatctccctaagtgctcagtgtaaaggaacaggtttgtcattacaacagttttgtgggcctaaaaacagacaagttctactcaaatggtaacttaataacagggcttggctttgcacatccaggttcacgagttcaagggcagcatggtattcagagaccacataaagccctgatgctgcagacgaactgttctttgacacagaactgtggtttcgcacaggtcggaatcaggatggccaggatacttacgtagcctttgtagctggtgtctagctccggccccgtgggagttttgctgcgaatgatattttcggtttgctgtatctgaaagcggctatcatccagggctttgcccagttgtcggatctgtgactctagggcactgtggtcccctgcggtggcaaccataagaatctttactggacaaactatttgacttatttaaagcttgatattcaaggagaagtttcagaaatgatttcagttacagcagcatagaaatggcaggtgtgggtaattacaaagcaaatttagtaccatcgtgccggtgggttagacattaaaatggccaaaccaatgaaggtgcttgactgagagccctagcagatcggacgtcgcaaaacggctctccagtccgttttgaacagcttcgtgcacctgaccctcttccagctgaacccctgatcatctgaatgttgtcagtgtggaaggcctttctaaaaatctgcaatggtgtctactgcatctcagtaaggagaaagctgttctttttctcatgttctttctgctatcgcttagtgagcaggggaagatcctccctctgatttttcttcatgcacctcaggggaagatagtgtcacggaaggctcaggttgctgcatcatttactgaaggcataaattcattaatcaagaaaagagtgcctcagaatagatatatacagagatatcaaactagcaacgacttgctttttatctaagatctgaaacaaaaccaggagaaagctaagattttaacatttccatctaggcaggttcttactcatagcctagaattctggctcattctcctctcaaagttgtaacatttctttgtaaaattactgagagtgtgtgtgtgtgtgtgtgtgtgtgtcaaagtcttcgaactacacaggaacatttgatcatcagtgaagctagcatggggtgaaagcagaacaaatattagtaagctttattaaatgtttttatttgtttctaaaaaaggccttctagatacacctaggagaggtccctccctgggaatcaccctctcagtaatgttactttgctttctgtccttttgattttcttcaaaaactgaagcgtaaactagtaactccgtgattcaatatcatatcactgcgttcaaactctattccccgccgacatcccacatcactgatcctgaactcctgcactacagtttgtctaacacaacactaagcaaaactagttccatttttctttctttaattcttcttgtttcaggaatagttctgttcttatctatggctcagcataccgtgaaatacatttttcatttcaaattatcttttacgacctcttaaattaaaattacatatattttttagagctgaaatctgatctcaccccttgtctcatacgggattcttgagatgaggaggataaagtggtggatgggccaaaggtcactcatgcaggctggcggacttgggaccagagcctgcaccctgagtctccagccacaggtaggtctgcatgcagtgaagctgaaattaccacaccacgtagaacactagggcgcagaggctgatgactgggttttccttctcatattttctgcagttaatggacatgagaggtctatacctaatgagaccaatcaccatttaacaagttgagaagttactttatttcgctcaattagtgaaatcttattcttggtgtggatttaaccagctgttttttctagtacagcagtaagagaggaaggctgtgccttaacatgctagagccacaaagctgggagagagacagcagatgtgctaagagaggaggattgctatacaggggagggagggaggctggctccggcttgttgtgcctaccggaggtatttttgattgcattttctgtgagttttacataggcctcagggctttcggggatcattacatctgcaaaaaaagcacagtctaagttgacagctaagttctggaaaccctgaatcccttgtgcaggaaaataactttcctaggggaaaaaaaggaagtcagttattctagacacatagctcctgagcgcacagaggagcgtgcaggctcaccaaagctttcctgaaatgaatcataagaattcacagtgggtggggcgtggtggctcacgcctgtaatcccagcactttgggaggccaaggcgggtggatcacctgaggtcaggaattcgagaccagcctggccgacatggtggaaccccatctctactaaaaatacaaaaattagccaggtgtggtgacaggtacctgtaatcccagctacatgggagtctgaggcaggaggatcgcttgaacccgggaggtggaggttgcagtgagccgagattgtgccactgcactccagcctgggcaacagaactagacttcgtctcaaaaaaaaaaaaaaaaaaaaaaaaaagaactcacagtgactgagagtgtttttatgagccaggctctggtctgagcacaaatttatcacatagaaaccctatagggtacctgggaatgttattcccattttatagatgagaaaactgaggcacagaggaattaggttccttatctaagtttaaacagaaagtacatggcagaactgagatttcagcccagactccagagcagcgctgtcccatatatttctatgtgaactatatatgtaatcttaaaggtttcatagccacattagaaatgtaaaaagaaacttataaaattaattttaacactacattagacagggattataacatgtaatcaatataattattaatattttattttctttcttgtactaagtctttgaaattcatgtaagcatgttttccacgcacaacccatctcaatttgcacagtcccatctcagagctcaacagtcccaactggccagtggctggttttggacagctctgcttcagatgccatatgcctgactaataggccttactgtaaagacaaaatagaaatgagagaaatcattttctttttagaacagtgtcatcccttgggaatctgatgtgaaccaccagaaccaaacagaaattccccagatgtcctttgacagaatgtatgagatacatttccaagtgccacaaatcagcctccaactctttattctatttttattcaccttccttacagagtttctgtttctctgtccatcccttcactgcatgtgtggcttgggtggtggtccttcttgttttccttcacacactcttcctgtgggagctcctccgttcactccaggaccattgccatttacatgtgaatacctacccaatctgcatttctggcttctgcacttcacaccgtgcatctacgactggacttttgcatttggatattctgcaggtatctcaagatcaggatgcacacaagcaaactcatcccctccctgctctcacagccccacctcccttgcccacctgcacccacagtgctccttccctcttgtggtcctcagggcctaggaccacctgcatctttcaccaagatgcccagcccagaaaatcgcctccatcccagttcaatggactgagagttctggaggagtcttctctgtgtgatttctcacatcattcccattctccccattcccaattctgcttcccctagtttaggccaccaccctacttctgtctgaggttgtaaaaggtttcatttggtctctctccgccgaatatgcccttctccctgtggtatccagaaagatacaatatgaaaatctgcacatccctgaggagggaggatcccagcacctccctccgcagatcctgctgtggctccacgaccttcaggataggagccacagctcttttccatggtgaacaggctgcttcacagccaggctcttctccactttgtccattccatgcctgtcattccagacaaactgccaatgatcaaaagcaccaggccaatcacaaagcagggaggcttcccctcctttcttcctctaagcacttccgagcccacctgaccaactgcgattcaccctctggactctgctccatggtttctttcccgaagtctctcccaggactccggctttgtcgcccctgcttgtgtgtcctgccaccacactgccatctgagccccaaacacttcatacagtggtttctcactgtgtcccacactagagtggaagctctgggagaagaagaggaactgtgtatccctagaacctggcaaagcgcttgtcacctactaccacaaatctacgtggaataaatcaacggccacaccaaattttgcattttataatcacattcatatctaagtgttcacttaggtacaatttccccgcatgaaagaaggaagcaaatgattctggatagctgtcatgtttccagggcaatattaattccctctgactttcctttaagctggcaaactggagaggctctttcctacctgataagccaacagctccccggaggtagaaatctttgtcatcctgaccttcttcatcctcagagggcagagctctggacattgcagactccaggtcccgactgaggtcatagtcgtgatcccactccagggggatggagtccacactagccggggtgtctcgtcctgaccgctcgctccggaggggctgagcgagcgagagggagagattggaggaaggctgtggagaaagcaggctgtctgcagagcggtcgtgccagtgcaggtccgacagagctgcagagtcttccagctccagctccctgtctgagaggtcgtgctcatcgtctgggagctagaagggaagtcaaggcaaccctgtcactgtagtggtcagactagcttcttatctgggccacctgcctaccatgtggggacaatttttaacttcttatgagcaaataaataagaatcttctgatcacagaaatacaggggacagtgctgctctagagtttgactgtctgggttgaaatctcagttacgctgtgtgcttcctgtttaagcttggataaggaacttaattcctctgggcctcagttttctcatctataaaatgggaataacagtcccaggcatcccacagggttttttttttttgagtgggaaaaaattaaaaagtcttataaattatcctacataagcctcagtttcattgttggtaaaatgggaataacattaaaacatacttcaaataattaatataagattaaataaatattataaagaaaggcaatctactaccatgcccaccacacaacacctacacactggcaaggatcggaaataagagcaaattactaagaccttagcttgtccttatagcccagatataaaataggtttgatcgtagaagattccaaatactctaataacatctctataagtaagatgtgattatggtagcaattaggaaaacggaagaatgaaaattcacctaaacctaacctcatcaattaagaagctgttcactttgcttccttttattgtatttcttctagaggcttctcttatttcttctagaggcttctctagagcagtgctgccccatgtttctgcgatcaaaagattcttatttatcttccatagaagatatgagccaaatgttcttctaaactctttgtatacattaactcatctaatgctcaaaacaatcctttgtacagggtagttactgctactaaaccactttcacttttgaggaagctgaggcaagaagggtgaagtgagtagcttgccgaaggtgacagcgacaatgtaggacaaagctaggacttgaactcaggtgctccagctccagagtctgagctctcacccactatcaatacaacccaatcccacacgacttattctctttagatttaatgacaactaagaaaatcaatgttacatacaggcaggcggatcagtttcttatggtatctttccacacgcccgaagacctcctggcagtaccgtcggagctcatctagttcctcctcgatgatcgctgcatccaagggctcactcttttctatcagctgttctccttgggcaattatctgctcaatcttattgtggttcagtgaaatttcctgctggaaggcctagggagtacaaatctcatgtgattttgctattgttgttgcttacattgatataaaagaatcataatagatgtatttctcattacattaaaaaagacatgtaggggctatttaattgaccatatacaatcacaagacaagagtctattaccttctaaagtaaaacatatgcattttcagccagaacaggagtcataaatagaaacattcgaattccatgatcagaaaagcgcttttggctaataaaatttaccatcacaggtagtgtgggtagagaataacaggggaaaatattcaaacccaccgtaagttgacagcactggttatccctaatgaaagcaatggcagtcaatatactgtcactgaaataaatgtagcattttaaagaaatatcccgatcattttaatttcagatatcctcatcctatgtcaaacatgactaagagaagccatccaatgccacgccttcttctcaggtgattcttttattatttcagaacataggcaggtaaagttatgatttgaaaaacaaggaattccaggaggattatttagactcattctatgtgttgcaaaagatttaaatcactgggtatgtttcagtgttcacttttaattcaatacaataataaattgtggaagagctgaattgtccaatggtgaaaaagactcccaggagagaagagagggtagtaataatttccatcatcctgccagggtcccaagggacaagattcaattacacttggcagaaactttctgtggaaggatgtaaatgttgattcgcctgtgagatgacaggagagaggaatcaggggagagggtgaggcagaatagcagggtttactgtttcttccatcctgagaatccatgtctacgggcaagttccttgttttatcataacaacccaaaggttatgggcgtcatgaccattctttaaaaaaatccatctatcttgggaggaaaatttcataagcttccttggaaaacactcaatttgttaaatactcccacttttaggaaatccttacatctaatgtatatccctcctattcgaatttctagctagccactgtgtttgaattatatagtgaaaaatacaaaatgtgtttaaaattaacttggcatctaagaatgcagactatgaggaatgaaatcccgacataggaaagttgtattgctttgcaacatggaggttaaaggaaccatgtgaaggtgctacaaacacattagaaaaaataaacgaaaacaacaacaacaaggccaggaagggtggctcacacctgtaatcccagcactttgggaggccaaagcagctggatcacttgaggttaggagttcgagaccagcctggccagcatagtgaaaccccatctttactaaaaaaatacaaaaatacaaaaatttgccggacttggtggtatgtgcctgtaatctcagctccttggcaggctgaggcaggagaattgcttgaaccagggaagtggaggttgcagtgagccaagattgcgccactgcacttcagcctgggcgacagagtgagactctctctaaaaaaaaaaaaaacaaaacaacaacagcagaacatccctaacaccctggcaatcaagctgattgaaaatcaatcaagctgttgaaaaatatcaacaacaatatcgatatcaaataagataagagcactacccagatataagcaatagtggttatttctgggtagtgctctttatctgattttttatatattttacattttctgaatttttttgcagtccagaactaatttttcaaaagaaaagttatttgctatgttcttcacaaaagagccacaaatcctttcattttcaggctttcttcactttggtaacttgaaaaataatctattaccttgagttgctttattttagcttgaacatcacactcagaaaaatgttcaatattagtgagctgcagatccatctctgtgagccagaccagaatgctgtcccgcgcagtctcaaactcctcacgctggccaataaaatgctggaaggcaagaggaaagtagtaacaattatttttattaaaagtccttctaaacatatggagatggcacagcgaattccagtgttctgtaaagtcattttctcagcaagcaatgagaagcctgcaatcctttgctatatcactccccggtttactcctcctgccatcccattcttacaaaatcactgagactgtgtctcaagactgcattcaaatggcccagtcccatcctctggcctctaaattacagatgaggcatagcaaaaaccttgagtctgcgcaagatggaggtgacacgcttttgcaggttgtcccatctctggttgccttcgtgaaccatctgtttgaggctacatgctgaatcagtgcggttctccctggccaggcggcggtactgcttgttgatcagttccagctgcgtcaggcactcgtggacctgtcgctggaaagcctaaggccacagagaagcatatcagtgtgagaaatcagcgaaggactctcagtagtggctcctggttttcttattgtagcgtctgggagaatgggaagttacactatcacagagggaaagaatgatgtctaataacggtacacttccccttgttaatgcaaagtcatctagtcagcgtaacttaaaggaaagggagaatctatcaaaaaatatgaaaatggggagtagtaatgaataaacacacacgcatccaacacacatatatagacacacacacatacatacacacacatatacacgtagctttaaaaataattaatgtcctggaaacaaatattcccacaaagcaaaccactataaaaaatatacacgtgtgtgtggaaatgtgagtttgaaatgttgacaacttctgctgtcaatatggagaaaaagatatctataatggaactgtttatttgtaaaatatgtacttttctaaaaatctagaaattacctcaattctgctgtccattaggaaaaaacttaaaactaccttttgcaaaaggtcttccaaaaaatcaagctattataagcttttaagaaaagtaatttagtaaaatacaagtaactttatattttaaaaaatttggaacatgctctgtttcttttttgttgttcctgtgatttaattagtttttataaaacatgttagagctagtgtaccacccacacagtagcatcaatttacttttgaggctatcccagggtcagtttagagattctgaaggtaaaatattcttttctgccttttccctccaatgtagaagagccctatagcataagagtcatttggccaaaataaaatgaagctttaaaaaaaatcatttgtatgatttatgactgatttttatcttggcattagaccaaaatgaaaactataattaataaattgaaccgcactcatcaaatccccaaattctgttttccttggctcatcacactgtttacatgtgaccacatttctgtctcttaaattgctttccttgtgagagctgctttcagagccttcatcctaggaaatcc

SEQ ID NO: 11761 - DNA, 8905 bp, Human
aaaggacttcccattatgacctttgtccccaactcatgagtgtgtatatgtgttttctttccttttttgacatttaaaaaattatttattttttagagatgggatctctctgttgcccaggctggagtgtactggcatgatcacaactcattgcaatctccaactcctgggatcaagagatcttcccgccttagcctcccaagtagctgggactacaggcatgtgccattacacctggctaatttattttattataattgttacagccaggctctccctatgttgcttaggctggcctcaaactgctggtttcgaactcctggcctgaagtgattctcctgcctcagcctctctaatagctgggattacaggcaagaaccactgcaccaggcaactctttttcttttttgtttttttttgttttttgtttttttgtttttttgtttttttgttttttgagacggagtctcgctctgtcgcccaggctggagtgcagtggcacgatctcggctcactgcaagctccgcctcccgggttcacgccattctcctgcctcagcctcccgagcagctgggactacaggcgcccaccaccacgcccggctaattttttttgcatttttagtagagacggggtttcaccgtgttagccaggatggtctcgatctcctgacctcgtgatccgcccgcctcggcctcccaaagtgctgggattacaggcgcgagccaccgcgcccggcctctttttcttttttaatgaaataatagagctagtagaaaatagtttgctttttaaagtgcttacttaataaaataaaaagtgggcaactcgaaataaaaaatcaaacaatatctaacatgtttaaaagatttttaaaaatcaaaatataaaataatatcaaaatttaaaaactgggattctgttccccaaagttctgttcaaatctgttagatttatcttcccttgaccctaagtaatatcttgggcaagccctagagcttctttcctgacccttagttaataagatgttatctggtcacattcagtcacaataatagactcattttagtaataaacatcttaagactagtaattaaaactctttacttcacaccaagtttcctccccaagcttggcctgttcctggctggcagcctgaagtagggaaaggagagatatggtgaccttttctttgtacctttctagctaccctctataccctgaccccacatacataattgagctgtggcttctgactctactgggtttggggatgagaggcagtgagagtaaaatgaaggagtggttttaattaatggcacagctaaaactggattttgttctctctgcacatggcagatgtttaaagctcattctttcttttatgcaagtttttacaccatccagcctcatttgtacctcttgaatttttgctcagtggcctatcaccattcaggatcaagacaaaaatcaatgagcacttattgtgtgtcatgcaccctacaaagtgccaggatatttatccaaactcctggcaatgctaaacacaatgcaaaaagacatattagaaaacgaatcttattaactttaacttttcaactgtatttcatcataaagtcttactttacaagataattgctgttgtgaaaaagggaaaggtcatggtctcatttcccagatgttatttgatatatgctataaattatattacctccaacatagtctgcactttgaacttagaaaaacaatcttcagacggcatgcattctaattcttgaaataagtatgcccacaaactgtagtttaagacagaataggtatgcttctcatgttttaattcagttgaatttcagaagatctcaggaatgtacagaacgagaattaagaattaataagaataagaattaattaattgcttgacatagagtagttaggtgatttcctgaactttaagcttccacatcacagtatgaagttggttcaagataagaaatataataaattctcgcccaaggacagacctgaatctctagctgcctagaggctgactcaactgaaatcatggcgtttgacagcacttggaaggtagaccggagtgaaaactatgacaagttcatggaaaaaatgggtaaagactttatttctttgtggctcattctttgctttcttacaaacatttttctttctaactcctaaatctctaggagattacagatagcttacagatagctcctgatgtggtagagaggatccagaagatgttcagaggagggaaaccatattctcccttcttacattaggaagaatccactatctcactaatggaagaaaagattctttgagtgctgttctctgaaacacaccaaaaagatccagaaatgtttccttccctctttaactgaaaaatgactttttttgttgtttacagtaagaaaatggcagcgtgtaatgataacttccagatctgaaaatgttaaattctaggagatggaaaaacaaagaccatataagaaagtaatggaaaaggttctcttaaaatttatagcgctgaataagttagatttaattctgatttcttctaacttaaaaaagttttggaataatcttgagaagctgtgtagttttctccagggcgtttaatttaactgatttataatttgataccaatactctggcagcccatatactatacaagataggcaaacaaatttgtgtcattcccctaaaagaaaaatctgcatcaattatagcttacagtttaggaactctaagtttaaatttataaaagttgtagattcttatagtgattttggcttaatatttgctaattttctcatttttgtgtcagaaagaaatgccacaagaagcaaatagaactataaagttcaaaatgttaaagccactaagaaaaacaaaggggcatttaagaaaaaagaatactgtatatgtggaattaaagatgtgcttccttataaatatatgaatatacattttaatccttcatttgatatttctagaatttgatttacttaacactgaaatgaacagtttgttaatcttattaaggttgctcagctctaagattctataattctgtactctacttaatttttctcaagttatggaaaaacaactttaatcagttctcttgatcggattgaacctgaacttctgtagaagcaatctgaatgttcttgtgcaaaggcaatgctaccgagttttcttcccaccctcaaaataaacaaacaaaacataacttggaaaaataaacacttcctatgggatttgactttattttctccattgtcttaccttttacaggtgttaatatagtgaaaaggaagcttgcagctcatgacaatttgaagctgacaattacacaagaaggaaataaattcacagtcaaagaatcaagcgcttttcgaaacattgaagttgtttttgaacttggtgtcacctttaattacaacctagcagacggaactgaactcagggtaagaatttttttttttatgagcaatgcattcttgatttttctacccaatattaaaatgatttctgctctatttcattggatggtttaattaatgcaggtctccttcactaactgaagaagccaatgaagtttgtctacattatatattgcacaaattggcaggatatttaaatatgcttttatttttatacgcatctgtgaagaatctgaattgaacagtaagaattagaaaactatcttttgaatgactgaatatagacctattcataaagaaatttaaaactgtgtttttaaacagtacagcaaaagaagcctttagagttaatatgtaacttaactgtaacatgttgaaataataaaagaaatgaatagatgaacaaatgagtgagttaccaaatggaaagatttgatgtattgtaggtcattgggagtgtaccttttcatgtttaagataacacattttaggaagtcatcattttcaacaaattttttaaaaactttttttagcctcaacatttttctatttaaattacatgtttgtaatgacaatttaactactgaatgttttatcataagttatgtctttctttaattagtaccacaatcacacaaattaaaacaagcacagagttgttaacatctccatgaaactaattttaaccatgactatatttctggacacgtaacatgaaagattcagaaagaagtgctgctcatctgccttaaaattcagcgtatggaaattattgaagagaacaagcataatggttatcaacacatactctgtagcccaatggcctaggttcaatcctcactctgtgactttaggtgaatcactgtgccattttacagtctcctcttctgcaaagtagagataatagtatcagtttcatagggtcaccatgaagattaaatgaaaaagtgtgtctacagaactcagaacagtgcctgacatgtgtaagaccctaataaatgccattattattattattattattattattattattatgtaggggacctggagccttgagggaaataaacttattggaaaattcaaacggacagacaatggaaacgaactgaatactgtccgagaaattataggtgatgaactagtccaggtgagttgtcaaatttatagctattttcaaaaggcaaaaattactacaaaacaataatttttgtcactgctgagccagatcttcagtaaactgactacttcttttctcataaatcttactgattttaaaaatattgtatagctattttctgatgcctatttactaaagacaacttatatatgtcaaataatcaatgcctattttaactgaaaatataaatgactacaaaccaacatgtgttttaaaatggctgtatcccatatctgtataaatcttgctatcaagtacaagaaaaaattgtataaactcatactcatataatatatatgaatatataatataaaaatagtataaactcatatagtataaaactataatactactttttcttaacttagatgtaaaccttaaagataaattcttctgtttgttaacacctttcagacttatgtatatgaaggagtagaagccaaaaggatctttaaaaaggattgagcattattcttggcgcacagtccaaaatacaaattggacagaagatctatattgtaccagaactatttatttcaccccatcaagtataaggttactgattgattggtccttttataaacattggtatatttccattcatgccaaagcaaaagaagtaaaagctaattaggatttaatttgttttatattctctaagatatatatttactaaaagaatttgtgacattttaaaaaacaaaaataaatattgcgtccatgttgctttatatgtagccttgccttttaaaagaaaaagtatgtgaatatgaattgacagattgttttcgtagagagagggtcttactctttcactcaggctggaatgtagtggagagatcatagctcactgtaacctcaaactcctggactcatgcaatcttcctgcctcaggcttctgagtagctaggactatgggtacattccacagtgcccagctaatttttgttttgttttctttttattttttttagagatggggtcttgctatattgcccaggctggtcttgaacccctggcctcaagcaatcctcctgcctcagcctctcaagttgttttttttctttacatttgataaactaaaagcataggctgcatatgagtctttaacatcttgaactggttgtgaataattttctggcactggttgtaagtaatatctattattataaaaataatatatgctcaaccagaaaacttagaaataagaaacacaaatgtaaaataagtatttccataactcataatccagagataattgccattctgattttgatagatatcctctcagctctcttccctgggggcagatatttcccaatacataccactttgaataggatgataggaaataaatgatgtactacattaaattaaattattgtattacatttttgtacacatcagtcattcccacgcttggctgaaaatcaggatcatctgagaaacttaaacaatttctgcattcttaatctccactgttattctattatatcagaatcgctaatagaaccaagaattctagaaaatttcctggtgattctgatgcagcctgtccactaacttgtctttgagaacaatggagatatcagttatcaatgttatttttaaccacccccttcttttttgttgttgtgggttttttcacataaacacatacattgccaattttccagggctcaaaaagtttccttttattcatattttcacatgacgtaaaattttatgtgcttcacataattgtattttagcagggtacatattaggggatggagagggggtacaatttttaagcatttgcagctgcaactctatagacttttgacaaattctttttcacactgatgtagataacagcttaacatttacatagttcttactacttgccacacactgttctaagtggtatatacatatgacatatatattaaaatgtaggaagaaaaatgtttgagtacctgatgaaaatgaatagagagtatgtaatctttgaaaggtgaatactgcgtgttctcacttataagtgggagctaaataatgtatacacatggacacaccagagtgtagaataatagacactggagacttggaagagttggagggttggcagggggcgatgataatttacttaatgggtacaatgtacattattcagggggtgatggttacagcccagactttaccactatgcaatatatcaatgtaacaaaactatacttgtactccttaaatttatataaaaataccttaaatctatgttcattttataatttcataaaaatcttcacataggaaatagtaattatttagattttcacatgcttctcttcataaaagctcaatgtatttttatccctctaatcttatgtgtctaccatatatgaatcaggaaaaggcaggtattaatctcaatacaaaaactgagagagacaaaggcacaaagaagtttattagcttgtctaatattgtacaaagtccatgatgaacagaagaattaaatgtaggtcttgactttcagcctagatcattatgatctatgctattactcagcctgttataaacaaaaatatattaagaaaaaaaatgtccttaattcctcagtggcacccaagaatagcactctaaatgagtcaggtcagactgtaaaataatggtgttgagtgattagacacttatctatttctagtctcattgcaggctgacttttttcaccatttatatcctttctagaattaaatttccactatttattagtattggagaacagcctattatttgttaagtgacttccatttcaacaaccgtttttcgggaaaaccaaccttgtcattacaccaccctgcttggccaaaagagggtccctgacccaagagcagccaatctaccacaatttggccagatcatgagctctgtgtagaaggaaaaatgacaactaactgaacctgcaagaacctctttctagggagtttgaatttgagaagtacacagttagtagttgatagcaaggaaaaaggcttaaagaggacaaatagagcagacaataagtagaagtcatgagtacctgaaactatgaacaagcagtaaccgtagggtagatagcagaatgtcggggcagtcagaagcagttggagtagtagaagctgaaatatttacacatgcaatatggtatctgggatatgcttcaaattgctttctccccaatctaggattggggaggaagattgatacaagttggcaattcttgcagctgttgcaaagtgcctgacacataataacatatgataggttcactgaataggaacacaggaattcattatattcatctctgtacttctgtatgtatttgagattttccataacaagaagttaaaaatatagtacttacatacacatataactccagaatccaaccacttcccatcacttccactgctatcaccttagtatgagccaccattatctttttcctggattactgttacaactctctaaaaagcccaagaacttctaccttccctactccacccctttagtctctttttctacacagcagccagaaggatcctttaaaaatctaaatctgatcacatcgcttatctgctcaaactgctgcaatggcttccattttcactcagaggaaaaagccaatgttcttacaatgacctgtaagaccctatatgatcagatgccctgttacctctccaacacgtggtcctgtttttcatgaaatatctgggggaagagtgtttcaagcagaggaaacaccctggagcaaagacaccaaggcagtagcaaacctggtaaatttgaagaacatagcctggaaagagtccccaaatcacccagagctgaccaaaaacaagaccaatgttcaggaaacacaggctgactcagctttcctaaaatttaggaatgatgtggtgaaaaagaatgggttttagaatcacagacttgcccaaattcttgtctgcccatttactgactaaaattcaagttctgattctctatttttctcatttgaaaaatggggaaaatgtaatgattttctgagcttgttgcaattgaggtattatgtataaaacatcgagtgtaatgcctggcatatacctggtactcaaatgtaacataaacatgtacccttctcctctagagaaaatggggcaaagtatatcctgagtagatgggaaaactcttttcttaaaatacctctcatggagtctgcgtgagagagtgagccttggcctggtagatgaga

SEQ ID NO: 11762 - DNA, 222691 bp, Human
gcccctcaggcatgtatttccctacccaggacttgcttttgatttatccatgtcacactatgcacacatcaaaaacacatcgacctctctgctgtaaaacagaacgaaatcatgtcctttgcagcaacatggatggagctggaggacattatcctaagtgaacaaactcagaaacagaaaatcaaatattgcatgttctcataagcgggagctaaacaataggtatacatgtacataagaatgggaataacaagacactggggactccaaaaagggagagggtgggaagggggtgagggctgaaaaattagctattgggtacaatgttcaatgtttgggggacaggtacaccagaagcccaatccccaccattacacaatatacctatgtaacaagcaagcacatgtacccccgaatctaaaattaaaaaacaatcaaaaagcaccgacttccttaactggcagggaatagtttcgagaatggatgtaaacaccgaattccttaatgtagttgcagattctgccagttttgtctcaacctctggatcggttcctttttttaactacctttaattcttaaacagattgttgctattgctatgctatatacttattgtatcacttataaatgtataacctctgcaaattagtctctgaattgaaagtattcattggtaaaacgggtatttcttcaccataggaatagttggacatgtttaaatacttgagagctatttttattacaagcacacacagctttgtggtgttttttgttgagacagagtctcgctctgttgcccaggctggagtgcagtagtgcgatcttggcttactgcaaccttcgcctcctgggttcaagcaattctcctgcctcagcctcctaagtagccgggagtacacactaatttttgtatttttagtagagacgggtttttgccatgttggccaggctggtctcaaactcttgacctcaggtgatccacccgcctcagcttcccaaagtgctgggattagaggtgtgagccaccgcgcccggcctgtagtgtgtttttgaacgtatatgtgaagttgtagcttttttttttttttttttgagacggagtctccctctgtcgccaggctggagtgcagtggcgcgatctcggctcactgcaacctctgactccctggttcaagctattctgcctcagcctccagagtagctgagattacaggcgcccgccaccgcgcccggttaaacgttttgtatttttagtagagacggcgtttcaccatgttggccagaatggtctcgatcttctgacctcgtgatccgcccgccttggccttccaaagtgctgggattacaggcctgagacacagcgcccgacctaagctgtagttttatgattatgatttatggttgtgaggcattgatttaagacattttaaagcttaagtcgtcagatcctagaagaaaaaaaaattcaccaagacaagctaatgccattgtcataaatgggagtttggagaaaattttattaatatttgtttgggtggtttatgtacagcgttgaactgatttgaaccccgaccaaacactgtatggaactaatgtacggtaggggaaatcattaactgaagatgccttttttgttgctattgtttagaacgcagttagaaaatcttattttagaggttttaccccgttgacaaagcctcaacttttcttcaaaagaactaatttccattttacctcccctacattttgaacagaatatggaagaagccagcgccccttctccgcgggcgctgctgcaaccctgctcccgccggggcttccgcgcgaaaccgggaacactggagcagtaccgactccgctcgcctagaacccgccccagccgggcccacttccgccagagccctggccgcgcccgccccgccccacggacccgagattcgtcggaattttcccgcgacgccgcgggagcgcgcggggccgctagccaggccccagaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccggtaagcggcaggccgcagaacgcagcgagggcggaggcttccctcgggggtctggccgacacgtcagcggcgagagcgggaggaggaggcgaggggcaagagggaaggctcgcgagagcgggtgggccaggcgcgccttgcggtgggcgagaggggttcccgccggcgcagggctgtggctaaggctgaggcgggaggcgggaggcgggaggcgggaggtggcgggcggtgccagcccgcggggcggggccagggcggggaaagcgggggcgggagccggcgctggggtcgcgcggaagggagcccccggagaggcgggagccgggtgttggcgttttggttctttttgttcattgagcgcaggcagctatgtcttcttcaaaggagaggagcaaaggtgaatttctctgcctcggactcgtgggagccgtgaaaagctcgcccctttgagccggtcgccctctacagctggcctcgtcctccccgtccctcacacccctgcccccaaaccccattcgccggggcgccaggaggggcgaggtccaattagaggagcccggggcgcggctgttacccctcccgccctccgccttttattcccggagggaggcgggttcgcagaggccagtgtcttccctccattctttttgtggacgccaggccatatcttcaaagcccgtgagagatttttcaggtgctgtttgttggtttgctctttttaattttttaggtgggtgcgtttacaactacgaaccctctatgatcttatgtgtccagcgcaccgaatgggggaaaagacttggagttttataacatgggaaattgggtaccagaatcttaagggaagagaccaaggagttttctagcaaagtcctgtatgtgcctggacttttgttctaatctgaaacttggaaaactcccgggcatctgattttattctaacttgtgccccatttaatgcatctaaactgtgatgtgatttgacttagcatttatcaaatgagcagagcacttttgggccacccaacttcagctctttgtggctgtcactcactgtcagtgatatgccctcagacagatcgttttctccttactcccctgaaaggttgttacaaacagtagaattcataccatgtgttgagatcattcattacctaagcttagatggaaaacatgttcattgcgactttatacattaaacttgaattgatgtttcaatgttatgtgctgtaccagagtcacctggaaataagcactcatatacattattcatatacaagaaaggctgcatcgaaaaagaatttgttttcctagatatatcagagatctttttcaccaacccactactcccagtaatagagcctgcttcttgagaactggactaattatactttgtatattatacattcgaatttatttttgctttattcggtcatattttctcttgatttctccaaaaacgtttaccaaggcatcagaaaagaaaagcaggctctatattggtattttttgttttgtcctctaataaaaagcattaacttgattgattggctggttgtggaagatgtgttgctgcatgtatgtgcaactgtgcatgtacattttaaaacaaatggtacttttaaccagttccatatttcagcaggtagttccaataacaattatacaaatttcgtgtttatgagaaccagctacagggaggccagcctggccagtagaaagttggattgattatctgggccatggagagagccagaggaaactcacatgagtggtagttccaagttggtagtgttagggcctcaaatcgggctggaaatgagcaccaaatgatttttaaaagttttattttaggctgggatatgtgcattctctgtcttgtttgtggatcttgagtgattgacttaatgtgaaagaatacatacaggagaagcaccttggaagttttgcaatgttttaataaaaatgcagaagtggagaaggaaaggcaattcagataacaggcagagcatggtggcttatgcctgtaatcccagcactttgggaagcggaggcggaaggatcacttgatcccaggagttcgagtccagcgtgggcaacagagagagccctgtctctacaaaaagttaagaaattagccggccatagtgatgcggggctgtggtcccagttactcgggaggctgaggtggaggatcacctgagttcaggaggtcgaggccacagtgaactgtgattgcgccactgcactccacactgggcagcagactgagaccgtgtctggaaaaataaaattggtaacaattcagattggccaccagagttggactgggggctagcaggcaatggttttacctccattttgagattggcatcttctaactcaagtttaatacgggactgagggtaagagacctgcatgccttttatgtcagcattacattatcttgattatggcagctttatagtaagttttgaaattaagtagtgtaagttatccaatgtttttcttcattttcaaaattgttttggcggttcagggttccttacatttccatataaattttagtatcagtttgttattttttttcagaaaaccgtgctgtgatagactttgtaggaattgcatttaattttgcatatctatttgggggagaattgccatctcatcatgaacatggaatctctttccatttgttgagcgctttaatttctcttagcagtatttagtaattttcagtgtacaaattttgcccttttgtaaattaattttgaagttttatttttgatggtattgtgaattgaattatttttaaaatttcattaaaattttttttatcgataaagtgaaagcaagttttttgttttttttttgagacagagtctcgctctgttagcccagactggagtgcagtggcacgatctcggctcactgcaatctccgcctcccgggttcaagcgattcttctgcctcagcctcccgagtagctgggactacaggcacccttcaccacgcccggctaatttttgtatttttagtagagacggggtttcaccatattggtcaggctggtctcaaactcctgacctcgtgacccgcctgcctcggcctcccaaagtgctgggattacaggcgtgagtcactgcgcccggccgaaagcaagtttattaagaaagcaaaggaataaagaatggctactccacaggtagagcagccgaattatttttaaaatttcattatggattgttgtcagtatataaacatacacttgatttcacttattaatcttatatcttgcaaccttccttgttgaacttgatgattacttccagttttttgtgaattacacaggattttctacatacggcatcatgccaatatagttttacttttctttccatgtggatgcctttagtttcttttttgcctgattaatttttttcttacctggttcgaccctccagcactttgctgaatagacatggagtgtatattattgacttatttctcatcttagggggaaaacatttaatcttttaccattagatacgacgttagctgtaagtttttcataaatgcactttatcaggttgagagattttccttctgttactagattgttgagaattcttatgaacaaatgttagaaatgttgcttttctgcatctattgagatgactgtggttttgttcctttatcaatatgatttattaactgatttgtgtatttatactaaccttgcattctaaatcccatttagtcatgttatataatcctttttacatattgctggatttggcttagtaatattttgtttaggatttttgtattatgttcatggtaatattagtaatattttgtcttgtgatgtctgtctggctttggtattaccgtaatagtggcatcttagaatgagttgggaagtgttccctcctattttttcagagtttgtgaaggattggtatttttttttcttcaaatatttgatagaattcactcacaaagtcatcagttcgtggatatttctttatagggaaatttgaaattacaaattcaggttctccagcgcacgcatgcgtgtgacttctccggtgaaggttgtcgtgcgcgcacctggccgtgactcctccagagcgaggttgtgcacacatgcgcgcgccttctccatcgccagcttccacatactttctccagcactggttcccaggcacacacgtgacgcttctccagggcggagctcccatagtgtgtgcggctttctagcgctcactcttggtgggtgtgctttgccagcgctagctccctggggtgtgccgcttccccaacgctggctcccgtgcttgggtgccgccccagcacctgttcccaggcgtgtgcacgtctccagcgctaggtccttggcatatgtgcttctgcagcgccggcttctgtggtgtgtatcttccccagtgcaggctcttgtagtgcgctgtgatcagctgcacccaatggtcaactgtgtacctcagcatccccctcaggcgattttgtaactgagcctgtggtgggacacctccctgtgaacacttttcctggcgccctagaggatgggtttctggcaagttaccaaaggtggttttccagcaagttgtactggtacagcacccacagagacatctctcgtattcagtgagccatggctgtgctccctccaaaaagttcttgatcccatttctgggaagaagtgggtatttttccttagggcacccacctcagccctaggggcagtggctcctccttatatctcctattcctgtgttttgtagaattctctgtacttcttactagccagcaccttgttactccagtcctgttacagtgaatagttcttgactgggcatggtgacttatgcctgtaatcccagcactttgcgaggccgcagggcttgggagaattacttgagactaggagtttgagacaagcctgggcaacatagcaaaacccctgttctacagaaaacacgaaattatctgggagtggtgtgtgtcccacctactacggaggctgatgtgggaggatcgttgagcccaggaggttgaggctgcttggagccatgattataccattgcattccagcctgggcaacagagtgagaccctctctctaaaaaagaaaatgacaacaacaacagtaattatttatagttgactttccttattcaaattattatgtggtttctttttactgactggacccagactgatttatcacctttgctctgaacttcctcaagaaatcatgagtggtgagagtatttagtctgttcattttcttgaattgtgaaagttaatcctaaggtttctcccacttccacatgacgaaagacacgtttgtgtgagagtatgtaggcttttatgaagtgatgaaactgcctttccatgcctttgcaaattagaaacagtatagattatcatggaaagtggggtcagagattaggaggggaggagaagaggacaggattagaactgtggtcgaccttatggcatccagtgggcagggttcccagatgacctgactttagatgtgactgtacttctcattatctttcacccctgtttttcatttttcagatttctgggacttgtgttttcattttcctctagagccccaatgatgcttttgtaattcagaaacatttatgtgtgatataaacattttatatacatttagctattttagtggaatctgagatctgttactctggtgactacccataagacagtttgaggctgcggtttttcacacacacacacacacacacacacacacacacacacacacacagattcagaggagactatttaaacaatatgaatttggctgggtgcagtgctgtgcacctgtagtcccaactatttgagaggctgaggctggaagattgtgagttcaagtctcctgggcaaaattgtgagaccctatctccagggaaaaaaataaataaataaaaggctatgactttatgtctgtgattccttctttacctggttcagttcaaaggtatggaattgccagacacttttgcttcttttataagattttggaggtgccatttaccttagtgacttccaacaccctcctatggctggttcctttttgttgtcattttgtttttgttggttgttactgtttacttaaagctataacattataaggcattgtacttagcctaatcctatttttgtaattatgcttgtacattcaagtgctgtactcaatagatttccttattaactcctgattttttttttttttttttttttgagacggaatctcactctgtctcccgggctggagtgcagtggcgcgatctcggctcattgcaagctctgcctcccgggttcacaccattctcctcctgagtagctgggactacaggagcccaccaccacgcccagctaattttttgtatttttgttagaggcggagtttcaccgtgttagccaggatggtcttgatctcctgacctcgtgatccgcctgccttggcctcccaaagtgctgggattacaggcgtgagccaccgctcctggccaacgcctgatttattgatgaccatttgtggttatgcataatgacttttcctctgtctttgtgcactgcagttcatattattgccttatgtgtatatgcttgtttccacaactcttagccaacttcttcagggtatattcttttttattatataactgcattgatgtttgttgagtgccaacatcctttcctcccttctctgtcataacagaccctagattttcttttagtagtcactattctatgggctctggggaacactgatactacctctagctcctgggggtggacttttattggtttaaggagtgtgttttattgattcgtcacagtcattggttaaggatgggcataagctcaagcaagtccagtctgaatacatctgaggtctgtctcttacttgggatgctggaacagaagtatgtactctatttttgggtggtatggatgtgatgtgacttctgtaatggctaaagctgttttgctatcatgagggaagcaggatggagagacagatcaactgtgaagtctgccctgtttctggacttgccagtttcttgaaccaacgaattccccccctccttttttttttttctcttttgaaacagggtcttgccctgtcaaccaggagtgcagtggcacgaacatagctcactgcagcctcaaactcctgggctccaggaatcatgccacctcagccacctgagtaactaggactacaggtatgcaccacaatgtctggctaattaattatcattatttttgtagagacagagtcatgctatgttacctaggctggtcttgaactcccagcctcaagctgtcctcctgcctgggtctcccaaagtgctgtgatgagaggtgtgagccaccatgcctggcctcccattattgttttagctggttttgcttggtgcagcaggggcatttaatgcttactaaatatttagatcttccctcacatttcccagttcacttgcagctaggtaggacattgtgattgttctagccaatagattttaagcaggttatttccaggtagaagcatttagtagcagattcctgacctagctatctcttctttttgcaatggtgattctggaggctaggtgttgagatgtctgagcacctgtcatgctggatccatgagtgactgtggagcagaacaacacccccaccccacaaacatgtgtgtcccacataacatgttggacatatagtatcagaaaaaagttactacatcataacttagcctatcttgatgaatagagttgggttttcaattactggaaaccaaaggcatcctaggtgatatagtataattttgtaattcttagtgtgtatttggtgatttacaatgtatgcagattatacattgtaattgattagtaagacacttgtctgaaggaatcagttatatttagccctagctttctgaatttggtgtacccaaacatgaccttgtccaacatggattgtaacgattacttagcctatctacccctacatattaaaggttataataaaacactatataaaatatacatttatacaaataatatcgaattgctgcttttgcttgaagccgttagctaggaatttccaatcataggccgtaagagtgagtaaccgtttattattggtataacagcatgcattttatttatgaagtagtattttctgcagtatttggcacccagaagagtatcttgtgtttctgatactgactagtaccattagaatttttagtcattacactaaaaaagttggcaaagctagtgaaacttttgcttgatgataagtattttgataagtggtgactttttgaaactatgcagccagttttaggagtaacagaaatatttttatatgaaatggtataatatgactgattttttcttaaaattgagtagttgtaagcaagaaaagtgcaatacaaatatctttttcttttttcgagatgcatctcactcggtcccccaggctggagtgcagtagtgcaatcataactcgttgcagtcttgccctcctggactcaagtgatcctcccacctgagcctcctgagtagctgggactacaggcatgaggcagacactgtgcctgcccttaaaaatatcttgaattttggtagtgacattcctttgaaggtattaaaagctagaaatttgtttcattctatcaaagtttcaggtatcttcatttagttctacacgtgtgtgctgtacccatctaatgtttgcctaaaattgtactgtctttttggttttaaaataatttaagtctaggccgggcgtggtggctcatgcctgtaatcgcagcactttgggaggccgaggcgggtggatcacttgagtcctggtggtcaaggatgcaggtcggctgggcaaggtagctcctgcctgtaatcccagcactttgggaggccaaggcgggtggatcacttgaggtcaggagttcgactccagcctggccaacagggtgaaacctgtctctaataaaaatacaaaaaaaaactagccgggtgtggtgacatgtgcctgtaatcccagctacttgggaggtggaagtacaagaatcgcttgaactcgggaggttgcagtgagctgagattgggccattgcacaaacaaacaaacaaaaagcggtgatctgtgattgcaccactgcactccagcctgggtgacagagcaagaccctatctcaaaaaaaaaagaaaaaaaaattaagcctaagatgtttaatttaaaaataagtttttaaaaaagtatgtttttgaggcaaaatggtgagaataggacaagtatttgaaaatattgtggtacttgatcagaaccacctttggttacattgttttgtggccaaagtggctatgactaaatgactacatgttattttaaaaacattgtttctaaggtattactgatgtacatgaatggattgatattatcatggagtggtttgttataaaagcgagtttggccctcttgtgctctgtcgctgtgtgatgccttccattgcgatgtgacccctcaatcttagacttcccagcctccagaactgggagctgataaatttctgttatttgtaaactactgagtctcacatattctggtatagcagcacaaaacagactaagacaggcagttgggcaacagcaagtctgagttcccttccagcagcaactggcaggagtgaaatcctggctgtcttctttgcagtcaaatgctctaccactgagctatacctactggctatcttctttggacagttgctgtttttcaccacaagcctgtctaattgctttactcatttaacttatctgttgtggactttgaatttatgacctttgtctaaagtaatttaagttttgaataattctgaaatgcattcagttgttaaactaacacttagaaaaaaatggacagatcagaacaaatttgtcatacttattggagaaattactgcactaatcagggttctctggtgacttctaagtttcatatctgtagaaaaggttattattattcttgagcagtaagatactgtataccctttataaatcagagctttttgttctgttgattttatacaaatacgttggttttataagcatggtttttttttgttaactacttcttttgatttcttaatttatttctaacattactttgggcaatagccctattaaaagtgctttgtactttccaaattatttccatatagattatatgggattctcacaataaccatatgtgctaaggtaagataggcattttaaaaaaagaaaaacagggctgagcacctgtaatcccagcactttgggaggcagaggtgggcagatcacttgagcccgtaagttcaggacgagcctgggcaacatggcgaaaccttgtctctacaaaaaatacaaaaattatccaggcgtggtgacatgcaactgtagacccatacagtgtgacatgcaactgtaggctgaagtgggaggatcgcttgagcctgggaggttgagggtgcagtgagctatgatcataccactgcactccagcctgggtgacagagcgaaaccctgtgtctaaaaactaaataaataaataaaaattagaaaagaaaaatagaatggagacttttcaaaaaaattactttggctcataattaaggaattcccaagagattgcccaaaggaggatagctactgatgaacttcttgggttgattgtgtgtgtacagcttttaaatgtgtcttaattgttatgagatgataaccttttcaataatcaaaagagccgggtatttctggttacccaaacccaactgattttagcagaaaacatttgccttaaataataacttctctttgaaatgtttagagagaaggaaactgagtttaatggcagggttgttggctgttacccagggaaactaactcctgtctggtgctctttttgttgcaccagtagttcgatgtccaagggtggctgaagcttcctatggaagcattgttaagcaagtctttcgcaggctttcggttgcatctttctactgtgtaaataggggcattaggagaaatgtaatctttgaatactgcccaaccagtttctgcttggtaatgtgccctgaaaccctcaatgaatgccagcaaacaaattagatccacagtgtatttgatacgcatgtcttttccccaaacaaaattcaaatttcacaaacacaaactgagtcattttccaaatgtttgtatatgaatggaagtttttgtcctgttcttctgtaaccaataccataaaacttctgaaggtccttgatgcatttattgtacaatgttaatccaaaacaaaactttattctgactaaacttgtaggtatagagagataccaaactcatttttgttgatcagtacaacatgtttgtaccaaccagatctaaaaaatgtgtaaaggagtgccatgctgtaaagaccttattacagttgtaaacatcagtgcagctgttacaaatctagcaaaacctcaggttaaacaatttcaaatttactgaagatgacattccagacccagttttcataacataaacactctaggaaatgcctttgagatgagtgggattgtcattaatattaatgccaccaaattcaaggctgagaagtcatttcttttcaagctttattttcactcctaattttggaataaaatatacttttaacctgaagtatggcgtgtcttttcacagcctgaaaacatttgatcctgttgcctttgaattgtaggaatgcaaaaatacagtataagtcttttattcttgatggtcatttaacttaaatgagtttgttagaattaaagttgggaagaattaactgttaatggaactcagttgcattgttcaattaaaaaataaaaggatgctaaaaatagttgctgtttaaggattgtattagtgtgagattttagaatgctgcatttagggaaggaattttattctaaagtgatttgaagcacatttttttgtggtcctgtctttcatctagacaaggtaggacaagcattcaaaacctgtaccagtcttaatctgtttttttcttcttagtttccacttagtgggacatctggtgaggtatcattttggccatatagtcatttctaaagtttctttctgtgctctgatttccaattaagtcttctatgatgtttgccaaatttaagagcatgcaggggtccactggaagtgctgaataactgggctttggcctaattctttgtgcatggctgtatgtgtggggtgattttgttttctttgcttgtttattggtaattgcattaaattccatttgcctttactgaatttttttttgttggacttttggggaaacctctaaattggataatagagcaattaagtgactgtttgtaagcgatcctcagtgctctattagagaggcagcatttatcaaaagaaaacagttgaatttctcttgtttaaacttgcttttgaaattctgttaattttctaataaggagaattgaagccaagcattgtcaagtaccatattgtaatctgaagttggtaactgtggaagcacatagttgatatggtgatacctttttcagaggaactttggctatttccatcagcataaaggacacaacagactgcatctattgccttcacctctgccttatttcttctgttttcccttttttttttttttttttttttttttgagatagagtcttgctctgttgcccaggctgcagtacagtggcacgatcttggctcactgcaacctccgcctcccaggttcaagggattcttgtgtctcagcctccaaagtagctgggattacaggcgctcgccaccacgcccacctatttttttttttcgtttttagtagagacagggtttccccatgttgcccaagctggtcttgaactcctgggctcaaatgatctcctccctcagcctcccaaagtgctgggatcacaggtgtgagccaacactcctggcccccttttttttaaaaaaaattaaagaggttgtggaggtttctttgaattcttttggtgtttttaaaaatgttatattttgagaagaaaatctgggcaggtacaaagaacccctccctttcctgtttgaaaacttttttgcagtcgccctggaattttccttcactgtcattcatccttctctcctttcttgatattgggtcttctgtttactttattttctttctttgttttctccctcctcttgatgtgaagcagatgttctagtatcttcctaaagcagaatgtgtgggagatgaattatttctagtcactgcctgttgaatgtgaagttattctagtcacatttgattgatagtttgtctagataagaattccaggttggaaattattttcctttagaattgtgaggcattgtttaatttccttctaccttcctgtgtttttacaatttcatgatgatgtgcctggtgtggatctcttctcatccattttcttgggcacttggtcagccctttcaatctggaaactcctgtcttttcgttctgagaatatttttggtgattatctcttcccttccatattggaactcattacaagaaagctaattaaggaagagtagagggttgtgttatgggctgaattgtgtccacccctcccccattcataagttgaagctgaagctgtaacccccaatgggactgtatttggagatggagcctttaggaagtcataccggtggggtcctaatctggtaggattggtggccttagaagaagaggtagagagagagatctctccccacatgagcacaaagaagaggtcatgtgaggacacaggtggctgcctacatacaagccaggaagagggctctcaacaggacctaataggccttgattgtggactttacagcctccagaattgtgagaaaatacatttctgttatttaagccaccatgtatgtgatattttgttatggcagcctaaactgacgaagacaggttgaggtcaagctaggacctcagcttcataaaggtgaactgcatgcgttgcaagagaatattaacatgatgctggtgcgcgtgtgttctcctttttgactggtccctttttgaacttagctcactcatctgcatatcaccctttgtgagttagcacaagtcattaacccaaggttctagatctgtgctgaccaatgccatagtcaataggtacgtttaattatataaatttacattaattaaaattaaataaaattcaaaattcacttcctcagattcattagccatattgcatgcgttcagaagccacatgcagctggcgcctgcagtattggatggacagatagagccagaacctttccatccttgcagaaagtctggctgtacaaccgtattctagatacttgccttacacctctccctctctcttttttttcttgtccagtgggtctgaacttttttaggttcaagacatacttaggaatactagaatttgtagtggacatcttcaaggttttaaaacaacactaagaagtaaacagccattatagtgcaaactctgccaaagtgtcatatgcatactgagtctataactgcgtctgcagtgatcatgctattcatttggccatgcttctgcagtatggcccttagaagagctgttttttacccctactgggctttctgatatgtttgtaggacagagaattgcaggaagcaggccttcatatctgagccgtgctgctctggtttgctgtgctgaatgttgctgtgctctcccggaagaggtaggcacaagtgctttagaaggaactgtcagaaccccactgctctactgagcactggtgagtctgaggattcacaggctaaaggcaggtcactgaaagcggcctacattctggaatttctcggaacagattatttcctgagatgacaaaaagtataattttggtcagaaggatcactgaatttcctggaatctaccccaccaggctgtgtcttcataggtgggaactgttctcaagaatcctcaaaacagccctttgaggtaggttctgtttcactcccaaagagaagcgaggttggcactcagaaatttcacatcatttgccctggctcactgaatgaactagtgaatagtgacgccgggttcagacctttccgtttttctttaaaacttgtgtttctttctaccagaatgcaactagggttggccagtggccccttctgtccaccacgtgggagcagctctcctaaagctgggctctgcattaaagggattgtttacaaattcattaaattaaacatgtttaattcagggtaaaaactgaatgatttagaagatcttttttcttttgtttttttctttgttttttttttttttttgagatggagtctcactctgtctcccaggctggagtgcagtggcgccatctctgctcactgcaaactccgcctcccgggttcctgccattctcctgcctcagcctcccgagtagctgggagtacaggcgcccgccaccgcgcctggctaatttttttttttttttttttagtggagatggggtttcaccgtgttagccaggatggtctggatctcctgacctcgtgattcacctgcctcggcctcccaaaatgctgggattacaggcgtgagccaccgcgccaggccttttttcttttattttaaagaactgttgttatttttatttcaattaaattgaaaaacacagggaaaaaatgcaacaacaacaaatcccaggcagggcatggcaactcacgcctgtaatcccagcactttggatcacttgagtccaggagtttgagaccagcctgggcaacatagtgagacctcagctctagaaaaaaagaattagctgggcatggtggtgcatgcctgtggtcccagctactagggaggctgaggtgggaggatcgcttggaggaggttgaggctgcagtgagcctaaatcagtcatgccactgcactccagcctgggcgacagaacaagaccttgtctaaaaaaaacccagaaccaaaaaaaacaaaaaaccccaacaaatccctcatagcaccagcacttatttttgaagacttcctgtacttacacatataaatattttgtacaaaaatgttatgatattataaatatttttctgcagcttccttatttgacttaagaatttatgatgaacatctttctgagtcagtcaggaatattcttcatgcactgttaactcctctgttactttaacaattttgtgtgtgtgtgtgtgtgtgtgtgtgtgtgtgtgttttgatggttattgttatactgactttagccacttttcatcattttagcctttaggtctctttttttctttgtgtggtcttaaccgagaaataattgcaagcgaggaacaaagtcttaaatttggtggcactcaccaccaaataattgcagatgtttgccttccttctacatagaaagagcccactctcatgctgtatttgttcttctcatcctcccctgtcttatttctctttcatttcgtttaattttaacctcaataccagacttattttgtgcagcccttggcctgctgcggagttatctttgccactggctctctttccagcccccagtcgctgatgtgtctcttggcagctagtgtaaatgatggtggtcctctcattctgacgtgggagcaccccaagtcagcagtaatatttggtgtaacaagtaccagggtgggataaccacatatccctggactgggattttaaaattgtcagttgtcctgtcatttgtggtttagggatcaacttgagcaagagaaactccgtctctactaaaaatacaaaaaaaaattagccaggcgtggtggcagttgcctgtaatcccagctactcaggaggctgaggcaagagaattgcttgaacccaggagtcggaggctgcattgagccgagatcgtgccactgcactccagcctgggcgacagagcgagactgtctgaaaaaaaaaaaaaagaaattgtatttatttcctacagacttctttttcttggttatcacctgacattgccttatcaggtattttattatgtattttattcctttttattatttttggcttaaattttccttttagtcttttacttggatcattctttcttattttctcctccatattttggattcttcagacttcttcccttttcttaatcttaccattaccagatttcccttctgcttaaatttcatgatccagtttttcagtggatggagatagaaggctgaggtgaggaaggtgggggtaaatacgatacttgctgaatttcaaatataaaacaagatattaaggaacttatttccttttttattccctatatttgggagaccatagaattggctggccgctaatatcaagtggcttttgtgtgtagacccttacaaagaaatgactgataaagtccctacttctgggagttctgatagtaaaaagtgtgacatccatgacacatacattgccagtcaatgatggatagaaatggacagactttgaggagatgagttttgagtatacagagataccattttgtgtgtgtgtgtgtgcgcatgcatttgagacagggtctcactctgtctccctgcctggagtgcagtgatgcggacatggctcactatggcctcgacctcccaggcttaaacaattctcccacctcagcctcccgtgtagctggaaccacaggcatgcgccaccatgtctggctaattttttgatgttttgtagagctgaggtctcactatattgcccaggctggtctcgaactcctggactcaagcgatcctccttcctcagcctcccaaagtgctggaattacaggtgtgagccactgcagggccgcagagatacagtatatttgtgataccattagtaacttttatttgacagagggttaagtattgactaagggataaaacctattctggggcttagaaaacaaggttttgctccaagaaggcggttagatgtggataacggtttcagtactgaatttggaacctttttactaaaatgtagtctacatgtgggtatctagcaatagagtcactgttagtaaagaactatatatgtgacatacagaggaaccacatacagtttcttaaaataatatgttcttcatctttgaggaaatcctagacaaagctggaaaaatttcaagttttcttattgctcattacaaattatagggattttgatattgtgcagttaaaagttcagtagattttcaaaactagttattaattgacctcggttctgcacatttttgttgctttgcaagagtacccttaaggctcaaataaagttaaaagtaaggtaaatggtgtgttagactaaaactgtattttttgtctgtcaacacttaaatagaaaaacaaactagcttaagaacatgactgcaatttaggatcttaaaaccatatataccgtagtatttttaaagcctgcaaccaaaaagtagaatcattgtgttttatagcactttgaaattctgtctgatgttactgtatgtctgtgctgtcctgatatggcttttggattgcgtttgtggtacaagattgatttcttgtatttgtatattacttggctgcacagatggtatccgcttcaaatctactaaataaaactagaacaatgattttgccagttggttttgactgcttttatttattttggatggctgtagtctttgtgaagatggcagactaaacctggaagtgacagctaagaacagaatgggtgggctacaggtctgctaattgatctcagcagaactcatgctacttctccctgggtacaagacgttttcttcaattgaatgttcacaggccagctgagccatcctttgctcccatatctctattgtccttggcccagaccttttctcatcctccctgggttatctcatccatttccatagctttagttactgtctctctgttgatgtttctacatctatgtcttcagctcaggcctgtttcctaacctcttcctcacatacccactgcctattggacctcttcatttagatgccccaggtctcttgtactcaccatgccctaagctgagcctgtctttttatccaagtatgttcctactcctttgttgcccctttcagtgtatggtggcataacacatctagttctctaatcagaaacctaagcaacatctttacctcctctctattccttttttttactatgtctgatctaaatactaaatactatgtgttctccctgataagcatctcttatctgggtgcttttctctattccttcatgtgactagactaggcctcagttactgtaagatggtcttccatcttacagtatgatcttgtctcccctggtggtccattttctatattgcttgtgtgatttttctgaaacagaaatctgagtatatcactttaatgctaaaaatcctccagtgacttacctttgctcttagaataaagtccagagtccttactctgttttgtaaagtccttttaaatccatctactacttgcttgagcagggtgacagtcttggtaaaatgtacttttatagccagaagtccccctcacacttaacatatcatgatgctttcctttcttgtgagaagcgagaaattttattgtgacattttgtccattagtaaaccacactcagatctgtgtgcccctcttccaaaaaatacattatacatatttctacaaagagagaaaacatgtaatagttgtcaggttcttttgagaaatccttttgtagaagttatgcttggtgttgttttaatgtttttattacaaagtagagagcctgtctgatgaatcttacacaaataaagtaatggaggtaattagataacaccacagcctttcctttctctccagaagaggtaacaagagtcagcattcatttggaagcagttgcccagacatgccaacagaagttgtgggcatctgtatctccttctaagaaagcgggtttcctgaaaaccttgggaaaggaaggaagagagggacggagagagggagggaagatgctatgtaggtgggccagtcaccagcagagggataaaaaatggtgagatcaaaatataaaagcacgagtagtgtattcctttggctggcctctatctctagatgccctaaaatgtttatctccattattataagtcagtgtagatgcctagagaaaggaggcatccctgatttgggcaggattctaaacaattgccttttgtattgttagtctacactttgctgaaagtccctcttgcctcagtctgctgttcccctggtgagcccccacatatggttcagttctcagtgtcaggtctctttttctggaaactttcctcaacaccccaaatctgggttaagtgctccacttagtctgctgtactatgtaacacttctcactctgcagttttagtttgtattttaagttcagtgactatgactaatgttattgtttgaaatgaaagagattttaagagtttcttcaagaggattgaccagagtcctgagacatttctccattcctaaatatataaaagccatgagttgcctttgaacttcattacaattttgaaaatttttagacatatcaaaggtattctgtagatgagagctagcccgcttcaatccagttgtgactatcttgagtgtgaatgtcagtgttcatgtttgatgttctttattttggtgtatactctaggtgtaaagccagcccaatattgtcccaacacatgactgtgtttgtttggctaactgaatacaccttacctgccttttctccactttctgtcttcatatcgaaatccatacacttgaaatattctaatccattagatatatgtaatttcctcatttatgctttactgaaaccctgttggaaaattcaaattaattacccttagattaaaaaaaaaagcctaacaaagctctgtggatttggtatgggaacatatcaataaattttttaaaataaaaaccacataattatttttaaagacaacatttattttcagatctgttgagtttttccacctatttcttcaaagttttccttgtcatccaaagacatgacatttgaggatctgtctctttactacttttctatttttcaggcaatgaaacctcttgttacatttaattagtgtgtctaggtcatgatccttagtcattttaaattggagtgtgatagagaggttttaatatattgtgcagtagatccttgatattttcagatgtaaaaggtttgttttgatttttaaaatcactttattgagatatgattgatatataaaaagttgtacatatttaatctatagaactcaatgagtttgtggataagtatatacccatgaagttatcaccaccatcaaaactgtaaacatacccatcacctcccaaagttccccctgcctgttttgttattatttttttgtgtatggtaagaacacttaatataagctctactcttttagtacatttttactatacagcataatattgttagccatgggcactatgcaatatagtagatctccaaaatttacttctcttttaggactgaaactttgtacctttaactatcacctctcaatttcccctcctgccagcccctggcaacagccattgtactctttttttttttttttttaattgatacagggtctcactgtgttgcccaggctggaatgagtggcgtgatcatagctcactgtagcctcaacctccggggctcaagagatcctcctgctgtagcctcctaagtagccaggactacaggcatgcgccatcctgcctggctaattttttattttgtacagatggggttttgctctgttgcctaggctggtctcaaactctggcctcagatgatcctctcttattgtggttttgatgtgtatttccctgatgattactgatgttgagcattgtttcaaataactgctagccatttgtttgtcttctttgaagaaaagttggttcaggtccctttgaccatttaaaagatcaggtttttttgttttgctttgttttgttttgctttgttttgttttgttttgttttttgttttgttttggtattgagctgtttgagttccttatataatatattctggatattaacaccttctcagatgcatagtttgcaaatattttctcccattctgtaggttgtctcttcacgctgttattttctttgctgtgaagacatttttagtttgatggatttttagtttgatgtaattccatttgtctgtttttgcttttattgcttttgtggtcttatccaaaaaatctttgcccagaagaccagtattatgaagcattttctctatgttttcttctagtagtttcataatttcaggtattacatttagcccattttgtgttgatttttctttttttttagatcaacatctcaaactttataatacactcacatttatacacaaatttctgtttacaagtacaaaaggcaaagaactgcaaagaagctaagcaactgcatcatcagccacattcaatcgaattaatactgttgtcccccgtccgtagttttaatccagaggaaatggtagatgccgtctcacacatggactccactgttagttttagaagttggagactgtgtgtggttccgcagaagtctgggtttctacagagctgaactgagactccatcatgttccaggccatatcagccagaagaaagtcgtccattgttgtttgagtttcgttgttggtgaagaacaagctccccagggtttcaaacccagaactcatggtctgtgtttctatactgttcaactgaactttgctttctagagcaggtatatctttaacagtggagattccttcagtttgtgtctctgtgtcagatgaatcagtactcatggaaaagctggagtgtttcagaatacttcccagaggcagatgagggctactgtctaagaaaaagtttaagtctgtctgtgtttgtctgtcaaacatctcaaggcctaagaagttagaatttcccctacacccataggactgagcagaggtatctgcgagtaagaagtccgtttgagtctctgtgtccagtgactccaagactggctcagtgttcatggtgctaagttcactctcttcagtttgagtctggatatgtgaggccgaaaagaactcttcaatatcaaaattgattccagggttctgggctgggccagatgggagctgggtgtcaggtccaggatttgtgttagacaaaagactatgatgatccaatgtctgagcaggcagattacttgacaagatgttttccaaatcacttaataaatctatggtttgggtctgattatctgtcatgttctgtgaaggaagcatactgttctgtgcactgaagtttataattggtgcacatttctcaatctcttgatttaaagtcttaggctcattctgaggtaacaaactatgagttactatctctgctactaaactgttgcttataatgttacttgtagcaacattatatgatgaatgaacactcaaaaatgtctctgcacattccagcttggtccatctgtacatggtcatccgttggactttgtatcccactggtttgagtttctcaggagaccccacccgactggaaacaggtgtccataaatgcatcagtctgagcagctatagatgaagttaccttagagctgggcaaaaatgtctgagtgtgaacactaatgggaagagacacttgagaatcaaacaacaaatcagtttgagaacaagacgacacagaggaatcagcggtggcccactgtgcagaaggtataaagttttgtgaggcataagacagatctgtctgcacgttgattgaagaaatgccgttcttctgacatgtgttccctagttcttgtaaagtattagatggacttttacccaagttcacttgaacaccagtacttattggctcaacagcaacaggatcagcaatttagaaaagaagtaggctctctttaagagagcaagcctctgaatctaggccgaggatcagggttcctactgacaagggcaggcagtaagtgcacagcccctgtggcagagccctgatcaacacctaacaccacaggctgggctgaggagtcggctgtaggcacaaagacaggcatgagagaaaactgcatcacgggtagtttaagcaaagccactttgggctttggtaaaagcaacttttgaggctatctcggtgatgttgtaagaaagagtctgcttgtcagtgttagagccacaagagtcttcaaaagatggttctagctttatttctgaagcttctagttcttgggtgtctggtctagggattggttggttgttaaatgattcagtggtcttgttggataacttctggttttgcacagttttccattttccttttcttactaggtgggtccctgtgttctgcagggatctcgtggccagttcggtagatgtgagactgcaatgcttttctactggcgtagggacagccgcatgtgcaccggaaggtcttgccacagtcctctgcaagtcttttcaggtcccattctgtaccgtacgaattgctgcacttgctacatttgtgcttcttctcagcatggattttcataaagtgctgttttacgagagaaaactgagaaaatggtctgtcagggcctctggggcagccttcgattggacaacagtagaatttcggtacagttttcaaatcttttcttattattggattgactgtgctatactgcatgcggtggctcttgaccaggtgcatgttgagcgcggggctgttgggcaggatcttgcggcagccgcgcacggtgcacaggatgttgggccatgtggtctgggacagctcgctcacctactgctggatcagctcccccgccagcacggaggccgcgggctgctgcgtcacccccgcgggccgcggccggctgcccctcagtcggggtcccgggggcacccacgggcccgaggcggcggcggaggctcctctcgtggccgccgggacggcgcgggcacccgccgccagagccgtggaccccgccgccgccaccgcctccgaggccgccatggctcccgcagggcggccaggcccagctcgcagttgtgttgatttttctaagtggtgagagatagggtctacctccgtttttctgcatgtggatatccagttttcctgaacaccattcattgaagagactgtcctttccccagtgtgtgttcttggcgcctttgtcaaaaatcagttgactgtaagtgtgttctcttttctgttccatttgtctgtgtgtttttatgtcagtactctactgttttgcttactatagctttgtagtatattttgaagtcaggtaagattgatgcctctagctttgtttttttgacgcaagattgctttggctctttggggtcttaatatatatatatatatatatatatatttttttttttttttttttttgagacagagtctcactctctcacctaggctggagtggagtggcgcgatcttggctcactgcatcctccacctcctgggttcaagagatcctcctgcctcagcctcccgagtaaccgggactacaggtgcctgccactatcctcagctaatttttgtatttttagtagagatggggtttcgccatgttggccagggtggtctcgcactcctgacctcaggtgatccacctgcctcggcctcccaaagtgctgggattacaggcatgagtcactgtgcccagcctccatacaaattttaacggacttttaaaagatacgaattcttccaatctgtgaacatggggtatcttcccattttttgtgtgtcttcaatttttttcaatattttatagttttcattgtagagatctttcacatccttggttaaatttatacctaagtattttatttctttttttttggcaggtattgtaaatgggattgctttcttgatttatttttcagatagtttgctattaatatttggtgtatagaaacactaatgatttttgtttgttgattttatatcctgcaacttgactgaattcatttattagttctaatagtttttttttagtggaatttgtagggttttctatgtactgtgtcatctgtaaacatagacagtttaacttcctcctttccagtttggatgccctttctttctttctcttacctaattgctctgggtaggatttccagtgctgtgttggatagaagtggtaagagtggacctcgttgtattgttcctgattttagagaaaatgcttttaacttttccccagtcggtatggttagttgtgggtctgtcacagatggccttgtgttgatgtacattccttctatacctaatttgttgacagttttttttatcatgaaagatgtcgaattttgtcaaatgctctttctgcatctattgagatgatcatatgatttttattcttggttctgttaatgtggtatatcatcttcatagattggcgtatgttgaatcatccttacaacccaggggtaaatttcatttgatcatgatatgtgatctttttttatgtgttgttgaattctgtttgctagtgttgtgttgagtgaggacttctgcatctaagtttatcagggatattggcttatgattttctttttgtgtctttgcctcctattcttagcagtgttcccttgaaagcaatttgtctttttataatctctgtctgcttttaggacttcctctttgcctttagtttctgcagttttactgtgtattttacttcagaggagtgtgttttgtcccattttccagaggtcttgttggactgagctctggttacctacccactctggtagttggcttaataaccctcctttcattggctgtgattccctgtgtcacttctctactttcttaatggtgttccctttattgtccaaataaactactctactcaaatccctttttcaagatctccttcttgggagtaatagggcttcttagatctgaggattaatgttcgtgttgatcacaatggaatagtgatattgctgacagaaagatatcattggttatacttggaagatcctcagtttccctaatggcaaaagacttgggaatctgtggatcaagatggagcatatatgatcccagacagaagtattgtttctcaggtcccccagagttccccaaaggatggatttgcatggcaagagaagctcccttatcacttctaatggggttttatatggttttggtcaattacccttccactgcttgaacattactcttctggaacccagtgacatgtgtgcctactcaggaggtagaattaactgattcacaacaattgccaaacgttttttagagtttactgcaaggttggatgacatgaagaccaattttctggaatcagtctttcagaagatgtaagcctcaggcatgtctgatttctattctaaaacgtgtggctgggcacaatggatcatgtctgtaatcccagcactttgggaggctgaggcaggaggatcacttgagcccaggagtttgagaccagcctgggcaacatagcaagaccctgtctccacaaaaaataaaaataatatcagattagtcaggcatggtggcatgtgcctatagtctcagccatttgggaggctgaggtaggaggatcctttgagccttggaggtcaaggctgtagtgagccatgatagcaccactgtactccagcctgggtgacagagcaagaccctgtctcagtcagtcaataaaatatcatacagttatggttaaaaactaaaacaaatttttaaaaatttgaatgaacaatagagaatgtattaatatgctttgaatttatattaattttgtggagaagaatcatttagaattttagctcaatcataagcctgtagatgatgacacatgaaattattatccccccgtgaaatacaagtgtgaaagatgactacctttttgtggtatgatttctatatactatactcacgcgcacttcaaggttcagttgtgtggtttttcagttcttactccagccactggttgtgcaaatactccgtgattgtgtaaaaatcatacctgttaatttatatatactgttactggcaggagacagacagatagtgctatttattagaattatatgtgcttctgagcattagttacctaatcaggtattttaaaagttcagaaaaaaatttttaagtctgaaccttatgtagtaactctgaaaaactatagaaaacagagtaataaaatataaaagtagtagattgaaatgatactcttcttattatcattatttctagagacagggtcttgctcttttgtctaggctggagtgcagtggcatgatccgtagctcattgcagcctcaaactcatgggctcaagcagccctccctcctcagcctcccaagcagctaggactactggtgtgtgtcaccacacctggctaatttttgtttgtctgtttttttgtgaagatggggtctcactgttaactgagctggtctcagaactcctgggctaaagtgatcctcccatctcagcctccctaagtactagggttacacgcttgcactaccaagcctggtctgaaatgagactcttaaaggaaacaggaaacagtgaacaaagagaagagtcattggaaattaaaaaaaaaaaaaagtgaaatgccctatgtgtgatcaaatagaagcactggattcagattatcaacaaactaatcaagatggaagagcataggaaatttcccctggcaagagcttggtaaccaagacgtcaggggccagagtgaaacatgctgaatgcatgagccaagtgctgggactcagttgacctataagaacaaataaaaagaaatccatgtaaatccatataaaacacaaaaccatggacacttgtattaaagtatggcttgtcaatagaatttgcatcagtgcatgctaaggttaagtcacagtcaaagcctattcaaagaatagcctagcggttttcaagtagctgggcaggtaaagaaaataccttgacatatataactcttaagatctgctgtaacaaatagttattatactagccaaaccaagtttaattttctcctatatatggtcttggtaaaggcatcatgttatatagaacaaacatgatcgacttggataatgaaattgtaaataaaatcctgctttacaaattattattgctgaaacagcctgtgttttagagaaagcaagaatgtttttagataaaagaaataattattccacttattaatattaaaattaaattatagcattttattttaatgtcagaagtacttgttctgtacagagattatgaagaactgggatcatgaatctgttgctgataaataaaatttcagaggtcttgggataaattatgaattcagtttgggagaacaggggttccttatcagctagaaaaactgattttactaccatatggcagtggtaaaaaaaagtccataccaaattccttatcttggatatgtatcttgaatttttatgcaacagaacagaaatacagttttgttcaggaaaaaaaattgcagaaatactactctgtgcagctcctgtctagaacatgcctgcctttttgttgtacacaagaaagagaattttctagtttaattccttgaagagcaatttgaatggtttccacttgggaaattatgtaatttcatattaaatagcaggtggtaaggtagtcagatggaaatgttcagttcatccagcatcatcagattgatttgacaaatggaattcttttaactctatggaaagcatttttctccctttatcctttggcagaggcagacattgtctgtggtttccccacaaaagtttgagtgggtaaactttggatgtgtaaatataaacagcagacagagacattgcctctgacagctggaaggatccactgaggatcttagaaggagactgctgatatggatgatgttggatagagagacttgagggaggaattaaccaatgtgaacataaatgaggaatgcacatgcttagaaaaaatgatagttcctccttaagtttaggttgaggttgttgaaaatttttgcttttgatatggataaaaacaacaaaaaactgacttttatggataaaaacaacaaaaaacaataaaaaactgacataccatgtggatgagcacatggtatgtttcttggtgagtggctccatctcgtacatgatatgtaaccttgggcaagatatttgggcaagatatttacttctcttttccttagtttccacacctgtatagtgggattgtagggactgagataagtttacggtgcttataattgtccttggcatagaataagcaccatgtaagtgatagctgctataaaataataataattattattttggtggattgagaaattcccttaaggaggaagctatttgcttcctctaataaccttagtatagttgatgtatttatatataaatgagatacagaattcaggagcaaattatttagtgtttaagatgatttataaagatatgttcatattaccttttaaaaattaaattgtgaagaatactgcaggtgcccgccaccatgcctcactaaactctgagcctttgcacgtgccaggaaagtgctgtggctggacactgggtctgatgatgctccccttttctttgcttgaacagtaatcagccctcgagactcttctggtttgtgaaatctttgtgcccccacgttatgtgtgtgtgctgccattagatcaatttcacattattattggaatttttgtttgcatatctgctaccccactcagttgtgtgttttccagtctactataaaatgtttcaaagattaaaaattacatcttttcattagccacagtgcctgctgcatagtaggtgtttttaggtaaatgattgaatgataaataaatcataccggtcatgacagtattcaaaagaaaacagttcttctcttgtttttcctgtaaggagcaaggaaatctttcctggaagcccctacaccagacatctccacgtattggcctaggatacagtcactgacaagggaatggaatttccctagttggcttggaaaaggcagtttgtgtttaaccacaaagatcactgcactggttacaaaaataatacatgattattataggaaatttataaattaatgaaaagtacaataaaataatctggcattacacaaagaaaactgttgttaacattgtggtgtttgctttccagtttttggttgtatatgtatatgtttgtgtgtatagaagaaaattgcaatcatattgtatatagctttttatagtcttacatttaagtctaacataagcagttttccgtaccattaagtcatatttttctgaaattagactaatggcttaagttccttcatatggctgtattacaaattatataattcattgcttattgttggagatatagattgttagcagttttttactattgtaaataaatatgcagtgaacatccttttatatcaatcatgtacatctctggttatttccttacactaaattcctagaagtggattaatgagtgaaagggtataaacacattcaaagttttttgatatacttctctgattatctttcagaaaacttggaccaattacattaccagaaacctgcatatgagtggctgtttaactgtattcttgccagtactgggaatttttttttttcaagacaggatcttgccctgttgcccaggctggagtgcagtggtataatcatagctcactgcagcctcagcttcctgggctcaagcaatctgtgaagtattttttaatcactgattttatagtcaaaagtggtttcactctgcttttttgacttgtagtgttacttttcatttagtcagcatttagtagatgtttgttgaaagaagaaatccgtgtttcttgatatgtatattgtttattcacatctattattggcattattatttttgcttttttattgtgatatacaaaaagtacataagctgtactaatgttaagtgtaaaactccatataatttatggcattctattttcagtttgctgttttggatattagtttgtttagtttatagtattataataatttataatattatctcagccaagtctgttgggtgagatttattccatcatagttatattctccctagggctcctaattacatagagacttcatttttggttctgactgagaaataaattatttctttctcaattcctttatattatttattacatgtctatggtttttttgcacaatccttctctttggcaacataccgttttatttatcttcatgttcttctagatatcaaaatctttttttttcagtatttagaagaaccattaaattatttcctttttatgctttctcccttattccttggctcagatttattttttctgtgtgtgtgcgtgtctctctctgtgcgtgtgcgcatgcgtatgtttgtgtgtgtgtgtgtgtgtgtgtgtgtatgtgtgtgtgtgtgtgagagagaggagtcttagagttcaagtaaatgatactttcctgtgttatttattaacagttacaactgctgttgttaatatttatctcatttaatctttttttgtctggtaagactggtacatatcattgtgtttttcatttagagggaagtgaaatattttgggccatactgttaatagtgctgtgtggatcagagctgagattagaacccagtatgctagtgatatgtttggatttcaagttataaactgtactgggtttagtcttgcacataaaaagaggctgaactgaagtttccaagatgttgagaaatttacagtttatttaaatttgagtcttgctctcaagtacactcttttcccagttatttgcagctagaaaagcaaaagtcttcaagtataatttaatatgaccaataggaaccacatgacttttacagtcattttgttgcgtactagtgtttatacaactcatgacttgacagccgaccaaactgtcttatccatctcatattaacatattgtgaatgtagtaggaactggcttagcaaaatcttgaaacctctgactctaatatttgtgggatagtaaagtaaacaactttggggctttcaggctgtgtgatgcacagcccgttcaggacattaatgcttattctctctgttgactccattgcttttgtgaacagttttgccgacaggtgtttaggcttgccaagagagattatttctagctagtagaggactcttggagaaagacattggtttctacttagaaatacaataactaatgataataactgacattgaatgggtgttaaaatgtgccaggcacaattctaagtgctttctgtgtaattaatgtattttattattcacagcaaccctactaggtttttcccattttacagatacagaaacggaggcatagactggcaaaataacttcccaaggtcacatagctagtatgttatagagtagggattcaaacttcggcagtctgcctccaagtcagccttcttaatcactctgttatgctgacatttattagatgaaaagaaagaggcacaggtgagtcataagtggctgtttgtgtttttggaaaatatttgactttatgcctactggcagcttgaaataattaagctgctaccattcattaaatttttatttttttgtaaagtgagttatttgcttgcatgtaatattataattggaacatagtgagtaaagtatacccttttatgtttgtacaaatttagggtaagcctgtattttcattaaaaaagtggtctttgagaaagaaagtgtttgaaacaaaactttgaagagtgggttcagaatcagggtgacagccacagagtagtaagttatttggtcaatgctctgtaataaatagcagagactgccttattggtcctgtgcgccatcttgaagagctgaatgttgcagaaatggcaggctaaatgttttggagtaacccaagctgactctaggcagaatttgtctttggcatcttctcattttgcctgtcactggcacctgtctcattcaccttttgtcattgccagatatggtatggtgcctaacaacctttactaactatcaacaagtccagctgggtgtggtgacatgcacctgtagtcccagcccctggggaggctgaggaggaggatcccttgagcccacgagtttgaggctgtagtgagctatgattgtgccactgcacaccagtctgggcaacagaggaagagccatctgttcaaaacaaaacaacaacaaaacaagtttctcataaaatattaattaatgtttaataaaagggatatcctttctcagggtatttgcatttaatagatcattctcaaagtttgggctttgggttatttttgagagttggcatttattgctataaacttccctcttagaattgtttttgctctatcccataggatttggtatgttatgtttccgttttcatttgtctcaggatatttttaaatttctctttaaatttattcattaactcattgtttaggagcatgttgtttaatttctatgtatttgtaaagttttcaaggtttccccttttattgatgtctagttttataccattgtggtcagaaaagatacttgacaagattttgatactcttaaatttaaaagacttattttgtggcctaacatatgatttatactggaaaatgattgatgtgcagttgagaagaatgtgtattctgtacctgttggatagaatgttctgtaaatgtttgttaggtccatttggtctagggtacagttcatatctgatgtttctttgttgactttctgtctaaatgatctgtccattgctgaaaatagggtgttaaactcttctactagtattgtgttacaatctatctgtttcttgagatctattaatattggctttatgtatttaggtgctctgacattgggtgcatatacatttacccaacatcagagcacctaaatatgtaacatatccttttgctgaattgaccaaccccattatcatatattaatataatgaccttctttgtctctatttacagatgacttaaagtctattttatctgatataagtatagccactcctgttttggtttccatttgtgtgaagtatctttttccatttatttactttcagtctatgtgtatccttataggtgaggcaagtcttttgtaggcagtatatagttgggtcttgttttctttttttttaaatccatttagctactctgtgtcttttaattggataatttaatccatttacattcaaagtaattattggtaggtaaggatttactactgtcattttattaatttttttctagttttgtagattctttttttctttctttcttcctttgaggttaagtgattttctctagtagtatattttgattctttgctttttatttttagtgtatctattataggcttttgctttgtggttaccatgggacttataaaagtatgccttatagttataaaaggttattttacactgatagcaactttgatcgaaaagaaaatactctttaactccactcccccattttgagcttttggtgtcaaaatttatatctttttatattgcatgtcccctaacaaattatcgtagctattatttttaattgtgttgtcttaaccttcttaaaaaaatatatgatgtacataccaccattacagtattagagacttcagaatttgactgtgtacttgcttttatcagtgagttatatactttcagatgtttttgtgttgctcattgctatccttttctttcatcttgaagaactccctttagcatttcttgtaagacaggtctggtgctgatgaattccatcagcttttgtcgtccagaagtctttattcttttcttcatttctgaagtacagctttggtaggtgtaatattcctggttgatagttttaatttttttttctttaggactttgaatttcttcaggacaatgtttctgcttagaggtctcttgttaggcatattagtactcccttataaattatttgcttcttttctcttgctgctttcaggatcctctctttgtgcttgatctttgacattttgattataatatgttgtggggtagtgttatttggattaaatctgactggttgcccttgatcttcctgtacgtggatagctatagctttctccaggtttgaaatactttctgttattatttctttaataagctttctactactttctctttttcaaggttcccccttgaacaccagtgacccacatatttgctctttagatgttactcataaatcctgtaacttcattcctttttcctttttcacctttagttacgtattttcaattaacctgtctttgaattcactgatactcctctaattgaacaattctgctattgatgctttctgttggattttttattttgttcattgtagtttttagctcctggatttctgtttgattttaaaaaattatttcaatctctctgttaaatttctctgatgaatttctgaattgtttttctctactttattgaagttagccaaatttccttaaaacaagtattttgaatttctgtcaggcagcttttctataatcctctctttaggatcagttactggcagcttatctttgtcccaaagcatgtttttcctcctttgggccagctggttatttagtagtgccttgttcagtttccacatttgtgaatttcctttgaaacttcctgcatttatttttaattgctttttttgtcatcagagcacatttgttatattactaatgttcttttaaatatatgaagactcattttatgacctagcatatgatctgtttagaatattccatgtgatcttaagaaaaatgtatatactattgggtggagaattctatagatgtaagttagatctagttggtttatagtgttattcaagtgttctgttttcttgttgatcttctttctagttgttttatctatcactgaaaatgacagtttgaagtctccagcgattaatattcaattgtctgtttctccctttctgtcaatttttgcttcatgaattttggtccttagttgtgtatgtttataatggttatatcttcctgatggattgacccttttatgattaacaaaatgtccctctccatctctaatagctttttgttttaaaatttgttttttttaatatcagtatagccacaattaagtttcttgtttttgtatgtttgcatgacatatcttttctatccttttacttccaatctgtttgtatttttcactctaaagtgtgtcttctatagacagcatatagttagatcatgttttcttaaagtctgacaatctttgtcttttgatgggaatttttttttttttttttttttttttgagacagagtcttgatctgccactcaggctggagtgcaatggcacgatctctgctcactgcagcctccgcctctcaggttcaagcgattctcctgcctcacccacccgagtagctgggattacaggcacctgccaccacagccagctaatttttgtatttttagtaaagacagcgtttcattatgttagccaggctggtcttgaactcttgacctcaagtgatccacccaccttggcctcccaaagtgctgggattacaggtgtgagccaccgtgtccagcctgatgggattgtttattccactcacatccatgatattattgacatagttggctttatgtctgaacttttactttttctgtatatctcgtcttttttttgtaactctgtttctccttttattacgctcttttaagtaagtattatctgttttttttttttttagacagggtctcactctcttgcccaggctggagtgcagtggcatggacatggctcactgccactgttgacctcctgggctcaagtgattctccttcctttgctgcccatgaaactgggaccacaggcatgcaccaccacacctggctaatttttctatttttgattttttttttctttttttttcttgagacagagtattggtctgtcacccaggctggagtgcagtggtgtgagctcggctcactgcaacctctgtctcccgggctcaaactattctcatggttcagcctcctgagtgattaggactgcaagcatgcaccaccatgcccagctaatttttgtatttttagtagagacggggggtttcaccatgttggccaggctagtctcttaagtcttggcctcaagtgatctgcctgccttcacctcccagagttctgggattacaggtgtaagccagcatacccagccaattttttttatttttttgtagagattttttgttgcccaggccagtctcaaactcctgggctcaagtgatccttctgtcttggcctctcaaagtgctgggattacaggcatgagtagtaactgatgcctgtaagtgaatatttcataatgtagcattttaatttctttaatgatgttttcactattctttttgaattttttttttttagtggctactctagagtttgccgtagaataagtttcagacttatgctcgcttaattaccgtgatatatagaaatgttactcctatacatatgatttttgacttatgtcctatacatatgattctcgacttatgatggagttatatcatcataagttgaaaatattgtaagtcagaaattcacttaatacacctaatgtagtgcacatcattgcttagtgacaccgtgcactgtagagtgttacttgtttacccctgtgattgctgggctgactgggagctgtggcttgctgtcactgcccagcattgtgagaaaagcatacttgagaagaatgtatgttctgttgttgggtggagagttctatagatgtctgttaggtctgcttggttatagtgttattcaagtgttctattttctcgatcttttttctagttgttttatcagtagttatggtatcacatatcagtagcctgggaaaagagcaaaattcaaaatttggagtatggcttctactgactgtgtatcactttcatatcattgtaaagtcaaaaaattgtaagtctaaccttcataagttatggatcatctgcatagctttattcccttctcttcctttttttgtgacattattgttatacatattacctctcaatgttatgaattcaacaatgttttaattattactttaacatgtgtagttacttccttagcccaatacagcttggctgtttaactcatttgcactgtgtttggcaaatatatttacatatcttattcctttctatatgttataggcccaacagtacagtgtgtacatatcattttatgcaattcatttttatgtcagttatgagaataagagagaaaaaatgtgcatttataattacataattatcagtgttcttttattgtgtggattcaaattaccttctggtattaattcacttttttttgcaaagtgggttttctagcaacaaattcagtttttgttcttctgggaaagtctttatttcaccttcatttttgaaaggtagttttgggggatatgggattcttggttgacaacttttgagcactttgaatatgttttcccatgtttttctgggatcttttgtttctgctgagaagtcacctgttaatcttattggggttcccttgtaagtaatgggctatttttctatttctgcttttaagactttctccttgtccttgactttcagcattttcactacagtgtttttgtttgtggatctcattgcatttatcttatttggggtttgttgatgttcccaagtgccaataaatttggggagtttatatgtttctttttaaaaattattttatttttaattggcacgtaatgtgcatatttatagggtgcaatgtgatgtttcaacacatgtatatattatgtactgatcaaattaggatgattagcatatccgtcatctgaaacattgtttctttgtggtgagaactttcaaaatcctcacttctagttattttgaaatatgcatacattatgtttaacccttttcccatttaggaaaaaaggtgcagctcactacccagcgctcatttaattttacattaatgtgctctttgaggctgaagcaaatctgacagattttcaatgtgaaaataaaatataaaaactgtttttggagttatttctaaacagaactaacatcagaattgtctgaatcatcagaatcatctatttcagaaaaattgaattgaaatggatctttggctaataactgttcaagaacaatgttaccatcatgcataggaatgctgcattttctaggatttgatattttcagcgattgagaattactatattttgtaaatggaaataccagtgctaaaaacagaatgttataaatagaatgatgttttttgtttccaaattcaatgtactagagcttgcgaaaatagtagtaaaagcgagcaaagttatctcagagtagacgctgcagcctcatgtactgtgggcgagtattctctgggcaaacgggaaaagggttaactgtagtcaacctactgtacaatagaatacaagaactctttcctcctgtctaactgtaactttgtactggttgatgaaccgataattatgctttttaagctcgtggaaaatgtttcagatctttaaccacagttagtaggcaaaagtactcatactctttctttgatttttgttgttgtcgttcttgagatcctactcaaatcaatgtggtgaagccttctgagtattgccagaccagatataattcttggggtatgacaaggaatgagtagtagcaccttatgaagccttaggttaggtatacatagaaataatcatgctgttacttgagattgccctgcccctaaataagtggtcttgaagatgtggtaggcaagggacagagaaagaccaagctccctgtgaccagaaaaggattatctgttatttagaggaaggggttagagaaaagctggcccattgaattaatgcaagaaaccagaggtactgttaggatattctgcagactaagtcagggtgaaaacatatttaagaacaaattcagcaactgagaaacttcatgtcttgaatgtgagaggcaatctcccatatgaaactgttagttgacgttgaaaattcattcatcctggtggttgggttaggaggagacccaagaagagcttttgtatttagtttcctggtggttggagagttcaaacactagacttggaagcagataatacctcatagtacaaggaacaggaacttttctcactgtctggaaaaaccaagcatctggctgtctgattttagtgaaattgtaattcagggggaactgattaattttattagacagggtgtgagtcctgtggctcctgccaggtgtaactgagatccactcttgccttctctctctgctcctgctatttatgatccttatgctcagagtgtgtagagtaggtttgcattcttttttttctttttagagactgaggtcttgtgaagttgcccaggctggatttgaactcctgggctcaggccatccttctgccttagcctcctgagcagctgggattacaggcatgcaccacctagctaggtttgggttctgtttggctacacttcctcctattcctgccaccaaggtttgtagttgtcgttgattttaatagactattttttagagcagttttaggttcacagcaaaattgagcagaaagtacagagatttcctctataccccatgcccccacatgcataacatccccctactgtcaacatcccccaccagagtggtacatttgttaaaattgatgaacatgcattgatacatcattatcacctgaagtccatagttaacattagagtttactcttggtgttgtacattctatgggtttggacagatatacatgtgtccgctattatagtatcatacagaatagttttatggccctacaaatcctccgtgttctacctattcactcttccctctcccctgcccgagtggaatttctgtttttattttattttattttttgtttatttatttttttgagataggttcttgctctgttatccaggcaggagtgtggtggcacaatcatagctcactgcaacatctacctcctaggctcaggtgatcctcctgccacagcctcctgagtatctgggagtacaggtacacacaaccatgcctggctaatttatttttcttttttttttttttttgtagagacagggtcttggtatgttgcctaggctggtctcaaactcctgggttcaagcaatcctcctgcctcagcctttgcaatcccaaagtgctgggattacaagcatgagccaccacgcctggcctgtttttatttttaaaaattacttgaggaactggttctaattccagtcctgtgctgaacttgtatcatacatagttcagagaattcctacctatgtagggactgcagatatcctccccttatccctttcctcctttcccttccccaaataatggcaagtcagtgcccatactgtgtatcagtccatttcattttttgagatttccttgatggtctgctaatttggagacacttctggacaaatgataaatttctggcagtacaagcccaaagtagtaaggttttgttctagacactggagctagaatgaaatttaaaaatggttccttgcttttacactgttggtgggagtgtaaattagttcaaccattgtggaagacagtgtggaaattcctgaaggatctagaaccagaaataccatttgacccagcaatcccattactgggtatatacccaaaggattataaatcattctactataaagacacatgcaaatgtatgtttattgcagcactgttcacaatagcaaagacttggaaccaacccaaatgcccatccaatgatagactggataaagaaaatgtggcacatatacaccatggaatactatatagccataaaaaagggtgagttcatgtcctttgcagggacatggataaagctggaaacgatcattctcagcaaactaatacaggaacagaaaaccaaacaccacatgttctcactcgtaaatgggagttgaacagtgagaacacatggacacagggaggggaacatcacacaccagggtctgtcagggggtgagggatttggggagggacatcattagaagaaatacctaacgtagatgacgggttgatcggtgcagcaaaccaccatggcgtgtgtatacctgtgtaacaaatctgcacgttctgcacatgtatctcagaacttaaagtataataaaaaaattaaaaaatggttcctactctctatttacaaattatgaccacttcatccaaagatcacaaattctaaagtgatacaatctttctgggtagccttaactaaaagagctgtatcactcttgagttcctctatgcatatgccaatcatttcctctttgctacaccctgttttgaagtgtctgcccagacagtagtactcatcaaccaccaatctttgtgggatgagcaactgaccccgtagaaaactatctaaagggtctgttggctggattgagccaatcacatcctcttccctgagaatggggaccttgagatactgagctgattagataatggttagttcttgggctgaaatttcgtatagaattgtgaccaccttctgaactacagcataaaagacgtgcaagctgggggaacaaaaaaagccacagacagcagagacagcagaggcagctagtgtacagagagatgtgcttgaacggagcagaaatgtggacaccctgagatgtggcaggagcttctagttccacttcctatttggaccagctaaaccttttctttccttgggtgttgttcatgagatctttggtcatagccttttcataacacctcttcccccatttgacttgtgctagttgagtggatttctgttctagagctgaaatgcagtgccagcagaatctagtgcaatagagtcttatgtaattaaagtcctaaagactctttgggttgtgagacacacaaaaagatagaaaaccaaggttgataatcagtacaaaataactacatgttggggtacccttcagtcagtcaatgtcttcctcaccggtaggcatttagtgactcgttcaccacccttccctcgtcgaggctaaagaatgcctacgtcatttcatcttttctcaaaaaagaaaaacattctgctgttttctgcttctttattgatcacatttgtccttaattccttcatataacctcaggtagaatattagtctaggtgccaggggatgtgggttctgttcttgttggggttctaacgggatggatggtctctgtaaggttcttcatctctctgtacccctacccccacacctttgccggacagtgaagagttatgctgatcaccgatttctagctgataactcccacaaaacaaggtgtgaataaagagtgtgaagaaatcaagctacttcacaggcatttgctatagatgaaataaatatgcctatccctcacttaatgatgttaattctaagaatcctgccagtaagtgaaaagctagaaaatgaaaaattacttctgttaatttttttgttgttgttttggttttgttttttgagacagagtcttactctgttacccaggttggagggcagtggcgtgatctcccagctcactgcaacctccacgtctcgggttcaagcaattctcgccacagcctcccgagtagctgggattacagacatatgacaccacgcccaactaattttttctatttttagtagtgacagggtttcactgtgttggccaggctgggctcgagttcctggcctcaagtgatccacccgcttggcctctcaactgcagccggctaacttatgttcattttagtggtaaaagttatgatgtgttccatcccaacctaagatgtccaaatactttctacaaatagaaaaatatatcattgagcaatgaaaactttttattagtaaataatccaaaattaaataaatgtaattggtacataaaatgtgttaaaatgatgctttgttgcctcaataaaaaagaggaggcggggccgggcgcggtggcttgtggctgtaatcccagaactttgggaggccaaggcaggcgaatcacgaggtcaggagatcgagaccatcctggctaacatggtgaaaccctgtctctactaaaaatacaaaaaaatttagccaggcgtggtggcgggtgcctgtagtcccagctacttgggaagctgaagcaggagaatggcgtgaacccgggaggttgagcttgcagtgagccaggatcgcgccactgcactccagcctgggcgacagagcgagactccatctcaaaaaaaaaaaaaaaaaaaaaaaaaaagaagaggcttgatgggattgatggaagagggaaggagccatactttggaaggtggttggtgagtcaggtgataaacttttaaggcgtgcattcagcagcaaaagtgcttaataatatttttcattggggattttgacagtagaagaaactcctaatgtggaaacctttggtatattggtagaagggaatcttcagatcaaaaaaaaaagcaagatgtaactttgcttccctttttgtaatttgcaattcatacacctccttgcaggatgcgatattagtttcccgaagctgttatagcaaattactacaaacttgttggatcaagagaacagaatcatatcttgttgcagttctggaggccaaaagtgtgaaaactgacatggccacattccctctggggacaccttcctctcacttctggcggccagcatggcattcctgggcttgtggccgcatccctccaatctttgcttctgtcttcactttgctgcctcctctgtgtctgtctccaacttgctctgcctctgtcataaggttgcatgtggcctaccctaccctgatattccaggacaagctccttctctcaggatcctgaatgttaccactttgtagtagttgttgttgtacaaggtaatagtcattcctttgccatgtaaagtaatattcacaggtcccatgtgctagtgtgggaatgaggtgccgacatttgggctgctaattctttgttgtgggagactgtcctgtgcttggtagatgttcagcggtgtacctggcctctgcccactgggtgccagtgacatccttctcccagctgtgacaaccaaaaatgtcttcaaacattgtcaagggtcccctctggggcacgactgtccttggttgatgagcactgctttaacctaatcagagcccattcttatcccactcaaatatgctgactgggaagtttccagtctcgttaagaagggggagggtggagaatggatgctggagaggtgactgctcctctccactacacctaacattctagtgaagtccacaaatgggccaaatcgagcaggattatgaaatttttgctagacccctgttagtgtattctaacattgtggcattttatattagtcaactaaatctcaatattatgttttaaaaaaatccaatggacctctgaatccccaggttgggttttttctactttacctatgttaaatatgttaaatacctaggttgccctttatcttagaatttgtccatgtatcacctcattctttttcagcaggtccctttctggaggttttcatactcagttggatttatcctccctgcgactgctgcctgctccttgccttgccatgcggcattagtagagtatgaactgcacatttagcacagcagtttatgcactagagaatcaggattggaatttttctgaagtatcttatttttctgtgaaataattgaaacagagtatagacacatttgctgttttgaagtttttatgatttccaaagtaataaatgtgcactctcacagttctcgggtggctgatctctggagtgcttgccgtttctccgggtggttgctttgtacaggctcccctctcgtgttggcctgcaagtgctctcgctgcgacgggtccctgaccggtactggatgagaggactagtactggtgcagatgttggcataaacaaaagctgcagctttttaatcatgactaaggcatgggagaggctgacatataattgtggggaaaagcgagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagtggaatggattaagggcggtgcaggatgtgctttgttaaacagatgcttgaaggcagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacaataatggttcccagagtgtccctctcagaccaataaaacatagcaaaactacgtgataaccaggctggaatgtatgtgaattgttcgagtgagtctgtgtcacttgaactgtactgggcagtacctaggggcttcatgtaaggcatgaagggctccagaaagaacccgctctttgccttcagttgtattctatatgtttaatacacagcacagcagaagcaatcagctctccccaatgttacttatcccataaatcatctttccttacacctacgtattttcttctgtattcaattttattaatggatcatctgatctccagctttgctggtttagaacctctgtgctcatcttaagctcctcaaggagaaaaggactattgtaatcatctttcaacgagtttgtaaaaacaattcccccatcacagcactgtgcctcatagggtttaaaatttgaccgaatgactgactttacatacatccttcccagaccctttaggactactgctcccctagaggttttctctgccctttggaaaacaggtaggggaagagggatctagaaatggcagtattcattaagatagccaaagcttgataggaagagacattcattttactgtggtaattaaagtgaaaatgggagaataagaaggcatgctgcttctttttcaggagtcttggcaagggttctagttttaaaagaaagagacacagccaactagattgaaatgatgtggagttcatccctccacagtcatattttactgagccatttttcaataaatggactaaattgtcccttggaactcagtaggtggtgctcttgtgctatagcatagcatcggctttggagaggttctgagagcacagcggctggttccagggcctgtgtcctgtcagtcccctttcatagctgccaggcacacacctggagggcatcacatggctggtctggtgagaggctttctgtctttggaaatgagggggtgaattaaggtctttaccttctctagcctgtctgagctctgctttccaggggaacctaaatgagaggttttctaaccttttaaagaaaaaaaaaatgtgactgtttatccaaacaattacgatgtgtattgttaccagttttccaagattttttatattgttattcatctgtgattcctcaaatcaaagttcctttccacataactcagggtatcattcttgtttatgttttcctttatgttaatgtttgtttcctgtttaagcttcagagaagatgcagcagaaagaaataaatatgtagtagagaaatttggaagtgatgaaggaatacaggtgaaagccatcgagttcatgcagcagctagtagtaacttagctgacaacagacccttttggcaggagcccattgctttactccttttgctatataatgagttccttggtccgaagttggttgtgataccatgatggtgaataaggaatccagtcaagtccacatttggtgatgctggagaagtgtggtgggcaaagaagataaatttaaatccagagtgagttatctattacaaggaggacaaatctgttgcctgaagcatttcagggtctgctttttcatcaagtttctgtaggggttgtataaaacgaaagttacttcacctatatccaccaactggtaggggagaggcaaaatgctagtgggactcacagcctggatgtgctgatctgacccattcagtcacctgtgatgtcgaaaggctaccagccaggtccgagtgaggccaggctgtggggccagcagctgggctcctgagctgtgctgctgcagatccagtgatgtgcagtgtgttttgtcaagacagagtgcttcctctccagtctactgtctagtatcttgtgcactgagtttttaggttttaatgaccgtagtcctgatttacatactttgcagttgatttttttttagccatcttttaattctgccttttcaatttatactttcttattttttaattagcttttttaaaaagcaccctaaatatactgatttttgttggttttaaaaatcaccttaaatatattttgttgggattattttagtgtcttaagtatgctttgttaggattttttagcatctaaatatacctatttgttggactgattaacttcatctgaagtgaatttgtgatctaatgtctgatattgttagttgcatttatttcttcatgtactttagaactttggttaaatgacatgttttgaatgaggttttaaaaacttttcactcattcagtcatttttcgcctctttctccctctctgcacactctcccctgtgtagcctcattctgcttgtctctgtctggcttccatggagcctgggtgcagaactagctttcacagtgggggcttagttacctgggcattcatggctgcttcacgcagtgcctggtcctgcctgacaggtgtcctccatcctccctagaccgccactccataggaggcaaggatgctgcgagccttccttcaggcatggaggggtagggctctagtcagcaccttccatcccaccttccagcaagggtgctagtttctcactctgtcgtttgtgcctctgtttagcccccaacccttctaagacccaaacctacagtttcattgcctgtttttggaccctagcataggaggggctggctgctcatggttttgtcctcggggtcttgcctctttgtgtttctgtctcgtatcgatttcatagaaatgtttattttgtgtgtgtgcttgcctgtatccttttccttttttctttttatgtttcccctctcattgctgtatgtttggagtaaagagaatccatccaaaagtgaatttaccgtgccatcttaactggaagtcacatgggcagagagtttaaaggaaagaaagatacttggttttacatagtactgaaagctaaccacaagaacgcttcctatgtgagctcagtgacccatagcatatagttacttaaactccgtctgaggcttgcaggccccaaaagatgagtgggattaggcaggtgggatttattagggtgctatggttctctacaaaggtttcaccttctatttttcattttggtggtaattttttaaaaattcataattccacacacctaaatgcctgcaattctaactaagtaatgtcttaaaatttcagtgcctggagttgtgtttgtattggtgccaaggagcactgctttaaatatagggagatattataaaagaacagaggtgaaaatgtaaataacgtgtttgagctaagagattgccgttgcacagtggttctgaagaggaaagtgatgcgtgaattaagctgtctccctgcatgtgttagtattggccagtcaacagaacctgcctgtcggtaccaagccctacatggttagtccaaagtgagtttcaatgactgcatcattgatcacgctgaattaattttgtcaatttaaattttactcattttgtagatttgttggtatttaatttgtatattttttatattgtggttgtgtaagagttacaagcataaaggttttactggtttatgtttgttaatatttaactaataagaagaatgactttagataatactgggagctctcaacagtttttaagtttgagaaccatgggtcaaatggtaatttaactcttgctgttggttgcagcaagcaccttgcatttgattttgatgtctttagctcactcctgctcatgcttcctgacctgcttagctcaggatcgtttctctctggggactctgacacctccatgccgggctggtgccccttcctcatgctgcctgcagccccctgtgtttccttctctcccagcccttcccacagtgtaatctgtgtatgggtcccaatttcctcattagccataagttgcttgagagtggggaacactgtcatctttttatttgcagtgattttcagagctcttgtcataaaataggctcctaataaatgtatgggtttccttgtttttgtttaggtagtaataaattacctgtagaatcaaggagagaaagaggcagaaataacttggagccaagtcacaaggcaagaagaagcttcctaatattttaataactaatgtgttcctcagctcactttctaactggtctaaccaaaacccaagtcttactgtcaggtaagtgaagtgaggacaagaaacgcaaggaaaggaagtaatgattgtaatagaatgcatgagggaaggctggtatttttcaagtccgaatgatggctccttggtgctctgatggagaacaaggtcagagatttctgtcttagcagcctcgatggcaagcgctgtggtgaagggatgcttttattttgaagccaagtccagagaatagctcctctccccccattgctgaggtcttgggtgggagaattgagcctagtaaatccccagagttatctgctagattcagtttccttaattctttgcaaagtcatctgaagagtatatatacatactctgcacctggattgaagttgcctcctccaattccttaggcccagattttgtttacaattgaggtttgtttgaaattatctgcaaatttcaggtctgtgtttttgattagactatctcagaggtggaacgccactgactcaacagagaaatagccagctcctcctagtggaacttttcttaaaacctcattggttttaggaggaaaaataccatttgtttctttcataagcacttaatgggaacaagaatcttttattgtgactttcaaaaaaaaaaaaaaagccacaaacacaggggtaaattgaccagtcttaccctgtgaagtgaagcaaagaaacattacatttcagcaaattaaaaatagttatcaggctttcatcaaggaagaggaagaatcttgtcaacttaagtggaattgaacataaatttcttaattttatatttgattatattttagggggttttaaatattttctgacaaggtcatggtgcccctagttgatgacattgattgattggaagctaagtatttgatttgtcttttttttctttttccataattagtgtgttttgtagcattctctccatacatctcctgtttggtgcttatttcatgagagaaaggacctcatgctgagggtaaatgggaaaaaagtgcactttatcaggtcgcctccactttgagaagcttatatggtccatatttggcatgagtagacttagctctctgggcttagagatgttttagaccaaaggaaagcattcttagactttcttgtccccctgacaggtaccatgtatagctacttttgtgtggtttaaaatgagctttgttttaaatgttaacaatcttggagctacaggggtttctatcaacataaaatcagtcagaattttatctgttttatttttcttctacaacagccttgttgctttttttatgtatttattttccatacatttgttcagtacatatttatcatgctcctacaatgtgccaagtattgtgtgagtttgtgggtttcaaaatatgctcagcaaactaggtcctgagatgtgtcagctaggatgtgtttgattgcaagtaacaggaaagccaaagaatggtgttaagggattaagcaaaaagagcagttccacatttggctccttcattgcctcaactatgctgtgaggacacggggctgtgattcttctttgctgtttgcagtatgttggccagtcccctcaggtttccttatccctgggtctcaaggtgactgttaccgttctgagtatcacacaaagactactatgtcagatatggaaaaaagtgaactcatttaaaactgaggaaaactgagaaaccttttgttgaagttcagttctcatgccctatatttccataatatacctgttcctacagtttgataggcgagcaaaagtaaataccatgactggtctgtactagccattcccaaaatgtggctgagggcccagggtccccgagacccttttaggaggttcacaagggtaaaactatttttataataatgctaagctgctatttgccttttcgactcgcattcgctcactagtgtgcggtggcgttgtcaagaggttacatgatagatgatgatgacctctctctgacagctaatggaatgtgtgtttgtatattttgtctttttaattgttctcagttttagtttctggtggtaaatatctatctatctatctatctatctatctatatctatatatatatagatatatatatatatacacatacatacacacacacacacatatatatataaataaaactctttggggtcttcagtaacattgaaggatgtaaatgggccctgagaacaaaacatttgaaattacctgctctgtgtgaatcaagattcacccctggcactggcggatatcccagtctccctaagacatatggccttgagattcctggacaaaactcttaacaaagaggaaatggagagcttagggctgctgggtgggcaactagcagtgtgtgcagccctgttctgagggggccctgaggagacagcagggcagggatgcagcatgttctccaggccccacctctgctgggccagccaggactggagccactgtaggtttgtcatttgtgtgttgttggttttttaattgtggtaaatataaataagattgtaaccatcttaaccacttttacatgtaattcagtggcattgattacattaacattgtttaaccattgccgccatccatccccagaactttcccgttatcccaaacagaaactctacccattaagcagtaacattccattactgtctcccctcatgaattaatttgcctctgtgaatttgactattgtaggtacctcatctgtgtggaatcaaagaatatctgtccttccgcattttgtctgatttcacttagcatggtgttttcaagatttattcctgtatgtatcagaattacattcctttttaaggctgaatgatattccagtgtgtgcatatgccacacttcgtgtatccttttctccactgatggatatttgagttgttctcacttttggctgttacgctgctatgaaattgggtgtacaaatatctctttgaaaccctgcttttaattcttttgggtatatacctagaagtgggattgctggatcaatggtaattctatgtttagttttttcaggaaccaccatactgtttttcgtagcagctgcgccattttacattcctaccagcagtgcacgagagttctggtttctctgtgtcctcatcaacacttgtcgttgttttcttgatagtagccgttctaagtgaagggagatggttttctgtttgtttttaatgaattaggatgcattgccccagcctgtcacccagcgtctcctccctctttgttatctttcttcagacactgctcaagtgttttaatgcttttacttccttctgctctcatgaattgtgcttggtgagctccatattcttgtaaggtacattttccatgaagtttttgaatatatccttctcctaaaggatagaattcaccaaaatgaggaacctttagtcctgaggtaatactctttgttgcctgctgtactttgaatctgagccatgttatctcggtgactcagaccatgagcccctgtggacagtggtgtatctttgtatcatggctatttgagttcataaaatagtacttaacaagcaaccaaactcttgagcaatttatatgtgtgagaagaagggcaatggcagtggtcctaagctgatgccattgtgaactggttccttttcagtatcttggatgtttgcatggccccatggctggtttcccttggtactttatcccagcccctcacctcttcctgcttctgaaggatccgctcccacctggcaggaaacagggacaggatcaagcatgtgtgggtccttcactggacactgccttctgttccagcgtctgcatctctctgctcatacgactttgctttagtcccctctgcataggaatttctgaaggtctttatttaatttctttattttctcctggaaatacttactgagggatctaacagcttctgttgtttttagtctgcatacgtggagaaggtgaaatcatggtttgttttgattccttagggactgggtaaatgcactaaaagatacattatgcaagaaatggaaaaagtggatttccttctgatttttcatgccaattgcttttgctgcattagtatatgctgtgcgtgtatgcacaaaatacttgttaacatcctgagttttcaggaaatatgttataaaacatttaccttttttatttcttaaaaatgctaaacagtatttctctaagagctagtaatgaaatgaatttaggtacatacactaggcagaatcataagaaagtcaaggacttacatttggagcaagataaaggattttggtattgagcaaaaaatatagtcagctgtcaattgtctaataggtttgtagattacctgcgataaaaaagtagtacatctgtgaaaaaagttgaaattaccataaatctgaagaatcagccccatttttcaaggcatgcattttttggagctgcacggaagccaccttatatgtctgcttcgggtgacactgtcttattcctccgtgaataatgaattgaacgtctctccctctttgtgacaaagccctctggggcaaagcagtagccgtacaggtaagatagggggtccagacagcaggttttggattttcccctccttagagccaggactggaaaaatggagtcattatttgaggactggaaggaaaaggagggagcaagtgctaggactgttatctctgcccatcctggtgggtggttttaatatttccagacagagaactcagttaaaaaaacaaacaaacagaaaatacatactatttcaacaatttgcaaaattttgttgtattcatcaagtactgtccatctttattcacatttataaactataatactttttccttttttctttgcctgtggggtgatgtctttatggtaaatgtgtatctggaagttttttttttttttttatattttaagttctgagatacatgtgcagaatgtgcaggtttgttagccaggtatacacgtgccatggtggtttcctgcacccatcaacctgtcatctacattaggtatttctgctaatggtatccctttcctagtcccccaaccccctgacaggccccggtgtgtgatgttcccctccctgggtccatgtgttcgcattgttcgactcccacttatgagtgagaacatgtggtgtttggttttctgttcctgtgttggttgctgagaatgacggcttccggcttcatccacgtccctgcaaaggacatgaacttagccttttttatggctgcatagcattccatggtgtatatgtgccacattttctttatccagtctatcatttatgggcatttgggttggttccaagtctttgctattgtgaatagtgctgcaataaacatacatgtgtgcatgtgtctttatatagcaggatgatttataatccttatatacccagtaatgggattgctgggtcaaatggtatttctggttctagatccttgaggaatctccacactgtcttccacaatgattgaagtaatttacactcccaccaacagggtaaaagcgttcctgtttctccacatcctcttcggcatctgttgtttcctgactttttaatgatcgccaattctaactggcgtgagatggtgtctcattgtggttttgatttgcatttctctagtgaccagtgatgatgaacttgttttcatatgtttgttggctgcataaatgtcttcttttgagaagtgtctgttcttatcctttgcccactttttgatggggttgtttttttctcgtaaatttgttttaagttccttgtagattctggatgttagccctttgtcagatggatagattgcaaaaattttctcccattctgtaggttgcccgttcactctaatgatagtttcttttgctgtgcagaagttctttagtttaattagatcccatttgtcaattttagcttttgttgccattgcttttggtattttagtcatgaagtctttgtccatgcctatgtcctaaatggtactgcctaggttttcttccagggtttttatggttttaggtcttacatttaagtctttaatgcatcttgagttaatttttgtataaggtgtaaggaaggggtcctaattcagttttctgcatatggctagcagttttcccaacacaatttattaaataggggatccttttcccattgcttgtttttgtcaggtttgtcaaagatcagatggttgtagatgggtggcgttatttctgaggcctctgttctgttccattggcctatatctctgttttggtaccagtaccatgctgttttggttcctgtagccttgtagtatataatttgaagtcaggtagtgcgatgtctccacctttgttctttttgcttaggattgtcttggctatatggacttttttttggttccatatgaaattcaaagtagttttttctaattctgtgaagaaagtcaatggtagcttaatggggatagcactgaatctataaattactttgggcagtatgaccattttcatgatatctattcttcctatccgtgagcatggaatgtttttccatttgtttgtgtcctctcttatttccctgagcaatggtttgtagttctccttgaagaggtccttcacatcctttgtaagttgtattcctaggtattttattctctttgtagcaattgtgaatgggagttcactcatgatttggctctctgtttgtctgttattggtgtataggaatgcttgtgatttttgcacattgattttgtatcctgagactttgctgaagctgcttatcagcttaaggaaattttgggctgagacagtggggttttctaaatatacaatcatgtcatctgtaaacagagacaatttgacttcctgtcttcctatttgaatatgctttatttctttatcttgcctgattgccctggccagaatttccgatactatgttgaacaggagtggtgagagagggcatctttgacttgtgccagttttcaaaggaaatgcttccagtttttgcccatttagtatgatatttgctgtgggtttgtcataaatagctcttattattttgagatacgttccatcaatacctagtttattgagagtttttagcatgaagggatgttgcattttatcgaaggccttttctgcatctattgagataatcatgtggtttttgtcattggttctgtttatgtgacggattgcatttattgactggcatatgttgaaccagccttgcatcccagggatgaagccgacttgattgtggtggataagctttttgatgtgttgctggatttggcttgccagtactttattgaggattttcgcattgatgttcatcagggaattggcctgaaattttctttttttgttgtgtctctgccaggttttggtatcaagatgatgctgacctcataaaatgagttagggaagagtccctctttttctattgtttggaatagtttcagaaggaatggtaccagcttctctttgtacctctggtagaattcggctgtgaatctgtctggtcctgggctttttttggttggtaggctattaattactgcctcaatttcagaacttgttattggtctattcagggattcaacttcttcctggtttagtcttgagagggtgtaagagggtgtatgtgtccaggaatttatccatttcttctagattttctagtttatttgtgtagaggtgtttatagtattctctgatggtagcttgtatttctgtgggatcagtggtgatattctttatcattttttattgtgtctatttgattcttctctcttttcttctttattagtctgactagcggtctatctattttgttaatcttttccaaaaaccagctcctggattcattgatttttttgaagggttttttgtgtctctgtctccttcagttctgctctgatcttagttatttcttgttttctgctagcttttgaatgtgtttgctcttgcttctctagttcttttaattgtgatgttaggatgtcaatttagatctttcctgctttctcttgtgggcatttagtgctataaatttccctctaaatactgttttcgctgtgtcccagagattctggtacgttgtgtctttgttctcattggtttcaaataacttctttatttctgccttcatttcattatttacccagtagtcattcaggagcaggttgttcagtttccatgtagttgtgcagttttgagtgagtttcttaatcctgagttctaatttgattgcactgtgatctgagagactgttatgatttccgttcttttgcatttgctgaggagtgttttacttccaattatgtggtcagttttaacagaagtgtgatgtggttctgagaagaatgtatattctgttgatttggggtggagagttctgtagatgtctattaggtccacttggtccagagctgagttcaaatcctgaatatccttgttaattttctgtctcgttgatctgtctcatatgacagtggagtgttaaagtgtcccactgttattgtgcgggagtctgagtctctttgtaggcctctaagaacttgctttatgaatctgggtgctcctgtattgggtgcatatatatttaggatagtaagctcttcttgttgtattcatccctttaccattatgtaatgcccttctttgtcttttttgatctttgttggtttaaagtctgtttcatcagagactagcattgcaacccctgcttttttttttctttccatttgcttggtaaatattcctccatccatttattttgagcctatgtctgtctttgcacgtgagatgggtctccttacagcacactgatgggtcttgactttttattgaatttgcaagtttgtgtcctttaattggggcatttagcccgtttacatttacggttaatatttttatgtgtgaatttgatcctatcattgtgatgctagctggttattttgcccattagttgatggagtttcttcacagagtcgatagtctttacaatttggtatttttttgcggtggctggtactgggttttcctttccatatttaatacttccttcaagagctcttgtaaggcaggcctggtggtgacagaatctctcagcatttgcctgtctgcaaaggattttatttctccttcgcttatgaaacttagtttggctggatatgaaattctgggttgaaaattctttaagaatattgaatattggcctccactttcttctggcttgtagagtttctgcagagagatccgctgttagtctgatggacttccctttgtgggtaacccgacctttctctctgactgcccttaacattttttccttcatttcaactttggtgaatctgacaattacatgtcttggggttgctcttctcgaggagtatctttgtggcattctctgtatttcctgaatttgaatgttggcctgtcttggtaggttagggaagttctcctggatgataccctgaagagtgttttccaacttggttccattctccttgtcactttcaggtacaccacacaccaattaaacgtaggttttgtcttttcacatagtcccgaatttcttggaggcttagtttgttccttttcattttttttttctctaaccttctcttcatgctttatgtcattaagctgatctttagtctctgatatcctttcttctgcttgatcgattcaactattgatacttgtgtatgcttcacgaagttctcatgacgtgtttttcagctcaatcaggtcatttatattattctagttagcagttcctctaaccttttttcaagattcttagcttccttgcattgggttaaaaaatgctcctttagcttggaggagtttgttattacccaccttctgaagcctacttctgtcagtttgtcaaactaattgtccgtccagttttgttcccttgctggagaggagttgtgatcctttgcaggagaagaggcattctggtttttggaattttcagcctttttgtgctggtttttactcatcttcatggatttatctacctttggtctttgatgttagtgaccttcggatggggtttttatgtagacgtcctttttgttgatgttgatgctattcctttctgtttgttagttttccttctaacagtcaggcccctctgctggagtttgctggaggtccactccagacgctgtttgcctgggtatcaccagtggaggtttcagaacagcagatattgctgcctgatccttcctctggaagcttcgtctcagaggggcacccgccagttgccagccggagctctcctgtatgaggtgtctgtcgacccctgcttggaagtgtctccttgtcaggaggcatgcgggtcagggacccacttgaggaggcagtctttcccttagcagagttcaaatgctgtgctgggagatctgctgctctcttcagagccagcaggcgggaacgtttaattctgctatagctgcgcccacagccaccccttcccccaggtgctctgtctcagggagatgggagtttgatctataagctactgactggggctgctgcctttctttcagagatgcccagcccagaaaggaggaatctagagaggcagtctggctacagcggctttgctgagcgaacatccctgcggctttgtttacgctgtcaggggagaaccgccttctcaagcctcagtaatgggggacgcccctccccccaccaagctcaagcatcccaggttgacttcagactgctgtgctggcagccagaatttcaagccaatggatcttagcttgctgggctccttgggagtgggatccactgagctagaccacttggctccctggcttcagcccccttttgaagggagtgaacggttctgtctcgctggtgttccaggtgccactggtgtatgaaaaaactcctgcagctagctcggtgtctgcccaaatggccgcccagttttgtgcttaaaacccagggccctggtggtgtaggcacccaagggaatcttctggtctgtaggttgcgaagaccatgggaaaagcgtagtgtctgtgctggaatgcaccattcctcacggcacagtccctcacggcttcccttggttaggggagggagttccccaatccattgtgcttcttgggtgaggtgacaccccacctggcttctgctcaccctccgtgggctgctcccactgtctaaccagtcccagtgagatgagccgggtacctcagttggaaatgcagaaatcacctgccttctgcattgatcctgttgggagctgcagaccagagctgttcctattcggccatcttgccagcctgtggaggttttaaaaactattttttaattgtagaaagtaacatattgaaaagcatataaatacgatttatactttggtgagttattaaaatgtggatagatagtcattgccacacaggtcaggaaatagaatattgccagcatcttggtgccattcttgcacaccttcccaatagcacatcttcctttcctctaaagcagggttccccaagccccgggccacagaccggtaccagtccgtggcctgttaggaaccagaccatacagcaggaggtaagtagtaggccagtgagcatcactggttgagctccgctccctgtcagatcagtggcggcattagattctcataggggcatgaatcctcttgtgaactgcacatgcaggggatctaggttgcacgctccatatgagaatgtgactaatgcctgatgatctgaagtggaacagtttctcatcccacaaacacatcccccccatccctgcccccgccctggtccatgaaaaaattgtcttctgcaatgggagatgggtgcaccagaatctcacaagtcaccactaaaggacttaccgtgtaaccaaataccacctgttcccccaaaacctatgggaataaaaaattttttaaaagagaaatatctgaaacagtaattactgagaattttccaagttaatgtcagacaccataccactaatacaggaagctttcttattttgaatggaagccggaagaaaaatgcactttacctgtagaggagcagaacattcaacttctcctcagaaaccatgtaaggaagaagagagtggagtgaaatatttaaaaatattgatttaaaatgttgagagaaacaccttacattattaagaacatgagctcagatacctctagggatctagattaagagagcctttgaatgactgagttctacctgtcaagactcagattcccagcagggtcagatatgcccaacaggtgtgatcatcccacatgtggccgatggcacagggtactttaattaaccagatgctggcagcagccatcacccacactccctggtcatcacaactacagcaccatgttttcacccctcccagccccagaggttgtggagcagcatattgaggatcagtgcactgcatgattcctaaagctgtttgcatttaaaacaatcagatacatttctattgctgagcgaaggttgtttgcctttttttcttttttagacagtctggctgtctcacacaggctggagtgtggagtgcagtggtgctatcctagctcacagaggccttgaactcctgggtccaagcgatcctcctgcttcagcctctagagtagctgggactataggcatctgctattatgcatggctaattaaaaaaaaaaattttttttttttagagatggggtcttggtatgttgcccaggctggtctcaaactcctggcctcaagcgatgctcctgtgaccgcctgccaaatgctgggattacaggcatgagccactgttccaggcctgcatttttttttttttttttttgagacagagtctcgctctgttgcccaggctggagtgcagtggagtgatctcggctcacttacaagctgtctcccaggttcatgccattctcctgcctcagcctcctgagtagctgggactataggcgcccaccaccacgcctggctaattttttgtatttttagtagagatggggtttcgctgtgttagccaggatggtctcaatctcctgacctcgtgatccgcccgtctctgcctcccaaagtgctgggattacaggcgtgagccacggcgcccagccccgggcctgcaattttatttgaataaaatgtttgtctcttttatcaaaaagttcttcattttactgggttcccaaatatctaaactgatctgcatctagtgccatatgaaatatataagaaattcatcagtttgttagtttcttcagtttctttgtttcttttttttttcttttttttttttttttttttgaatcagtctcactttgtctcccaggctgcagtgcaatggtgcggtctcggctcactgcaacctctgcctcctgggcaagtgattctcctgcctctgcctcccaagtagctgggattacaggctcctgccactacgcccagctaatttttgttattttcagtagagatggggtttcaccatgttggccaggctggtctcaaactcctgacctcaggtgatctatccacctcggcctcccaaagttctgggattacaggtgtgagccactgtgccccgcctcttcagtttgtttctttaaggacacagactttagagccagaccctggattcatattccacaatcatagctctgctgttaactagcagttacttcctttcagtttttacataatcttactttgggcaattatgtaatctcttggtgcctctgtaaaatggagatgataatagtacccatttcatagtgttgctgtaatgattaaattagtatgaataaagtatttaatatattgccaagagcatagtgtaaatgtatgcaagtataaactattattatatttataaaatgagatattactaattaaatttcacacaggcaacataaaaataccttaaaattttttttggtggggaattaccttttaaaaattaaattactggctgggcacggtggctcatgcctgtaatcccagcactttgggaggcagaggagggcggatcacttgaggtcaggaggtcgagacccgcctagccaacatggtgagaccccgtctctactaaaaatacaaaaattagccgggcgtggttgtgtgtgcctgtaatcccagctatttgggaggctgaggcaggagagtcgcttgaacccaggaggtggaggttgcagtgaaccaacatcgcaccacttaactccagcctgggagatagagtgagacttcgtctaaaaaaaaatacataacataaaaataaaattaaattacttcatctggagaagcgttttgctgtggcatttagcttagaactgtactatgaggaataccggtgaattattcattccttaattcagtattttttgagtgtttgccaggcatatgctgcattctaggaagacagggaatttacacaccagtagaggaagcggtaactaagtgaacgaataaagcccaggataattaactggaatcagcagaaaggatttgttgtgtgcatgaagcagatgagaggcatgggctggaccgtggtgagctggggagagaggaaataagggctgtcagagacggtgctggagccatgttttgcagggtcttcaagactccagcaagcagctgggagtatctacggggagtttaagtttcttttcaaggaagcgtgaagagaggttttacccaggggaatgtgctggtctcatttacatttgctaaagttttttctgtctactgcatagagaatgaattggagacgggcaggcccagcctggcagtagacaagtgcaacactccagggctaggctgaggggtggcaatgaggtggaaggaagtgcatgcagtcaagtcggatcacacacatttattttggtggtagacttgacaggtggtgatgatagcttggatgaggaagacaatgaggaggcatggacattatctagatttttggctaagtgccattttgacagttgcatatattccctctattattaaactttcttttcatttagacatgatccttctcaaaactgtaaatgttctagtgtgtgtgctgcccaagtgaacatgaagactgcacattttttaggtattttaaaactttcccgatctagatttttttgcactgcagccaaattgtacagtcgtttcaaatttcttctttagtaatgggaacctcctttgttgatatcttgggtatttaattgggagcattttacctgttaattatggttgttgaggattttaaactcactttatttaccactagtcttttgaaattacattgctgaatatcctgcctgccctggggagtgtcagagcctgtgaaggcctgcacctgttgagaggcagccttccctcctctgcgattcctgcttctggcttccatgggtgatgaagggttgtgggatgggaggggcagctggagccgctgagccagctccacctgagtctcactgtgtaactccattgttctttttagcatggccttcaggggtaggaagtcaggcttatgagattttatctactgtcactgggactagtatacctcctcagtaagtggaatttattattattttactaaaatatggtttcttcgtgtgaatgaagtgagatcaagcatataaagcaatctttagttaaaagattgcttaaattgttacatgtggaataaattattttacttttttctaagaaatgaagagaaactgggaaaaaaattcgttagacagtaatgcatagagatttttttacacctaaatgagaagccagaaattcatataaaacataagaacttcaaaaacatttcttaggcacagactattattaaacactcatggatgttttttattttctattacattaaaatactcaagtcaacttcatattcagaacatttaaaaatagctcaatcttaaaaagaagatataaagtattatcagctgtgctttttgtgcataattagcgtgtgcctgtggaggtataaagacttctagcctaatgatagtatcatgataaaaagttcagatggtaaaaattggagctccagctggatgacatattttataacaattcaaagatggctccagcatagaagccatgctattttagttctttgtaatccctccttcacccatcaatgggtcgtgaaggcactgataaaagagccttttagaaatgcttctatttgttccctttcttacagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggtaagtagtggaccagaataatgaaattattttctgacttcagggactctaccagatttcaccaagacagaatgccacccagaatcgggacttgtggtattgactgaagtgccgatggattaggaagacaaattactcaagagctggtttcctagtctccgatttattatattattataatttcttcttgagtagctgtattgttacatgacacttcctgaccaagcaagttgttcttaaataatcaagatttcatgcttgttgtcaagtagtaaatgggattcttttgaaggcctttgtgtcccttgaatcttggagaatttgctacatgcttaacccttcttcaaccctcttgtcaagtgggctgtcctaagagatgatagatattaagatctcttcttataatactttttataaatattaagattttgagtatctttactattatataatttattattttcaaaatttaatatattttcattttgatgtcatgtttcttttattatgatagatatttttatgatttagcacatgttgttatattatgagctagtattttgtatttaatttcaaaatgaaaagcaaaattgtcacttaacaaagtgttcttgtgttaagcttttcttcccttaatcaaagagtaaataggaaatttgaagaataatttgtattgataatatgagttcatatgtctttagaaactataaggaaagatacagtctgtgtgaacaaccgatgctaatttttagaattgtttttttaatgagacatacgtaacttgacctttatatggtcccaaaaagtgtaggaccaggcttgatgctgggacacatgtgagagatgttttgctgcagtagcagaaagtgcccattgtgttggcttacctgcatgttatcctagtttgcttttatttttgaaattttatgaaaggtaacaagtggaaaaaggtccggttgtacaatagcatgcatgtgtgtttttaaatcttaagctgttttctatttggttgatcctttttctatttcagggtttagattgttacagactatgatgtcatttgccatacagtactcaaaatagtaataaacagatatatacatttatgctttggctgcttttatttctttttacaagttccagagttctcatccctttaaaccttcttctttgaaatagtcttactggagctgagttcgtaacctctcttatgttagaataaaaaaaccaggataaagatacgggattatatagttattaatcaccaataatgtgttttcaactcttaagcagtctttattatttttaaataaagtagcctttactgactattaagtatgagtagaattaattttgcaacacaattgattttacctatgtcatacatcttagtttggtgaccccatttaaggatgaagtaagttggttggttgctttttaaactttatttgaattacttacctaaagatcttctctaatccttttgtgcttacttttaaaaatggtatactaaacaagaagcattcacgttccctcaatctataatgtcagttcagtatttctaagttgcataatgcctttactgaccaaaatttatttttctttcacaggattctaatacagtcattgaaagattccccacaattggtcaactgttggcaaaagcttgttggaatccttttattttagcatatggtaagaatcaaaaacgtgtcctctcaaaatggctattttaatctttgcattgtttcacagaggcttacattatgaacctttctcctagttttttttttttaatggaacaacttatcaaatgtattcattgttctattacaaagatggcttcctatactgttgtccatgtatgtgtgtgtaggtttgtatagataaacacacacacacacacacacacacacgtgcacgcacccatgcagatcttcaggaaaatagagctcttcgtattagaggacagaaactcccagatgatttaaatatctacttttgcctgtaatcactttcataacttcattttaaattcaatataaaatggctatactaatgataccgagttaattttgtttcacggtttcataactcacacactctttcccatgttgtaaagtcattcttcagagtgtgaatcctgccgtgactttgcctttgacattggctgctttgaccttatttaagggtgccattttggttttatccaaggtggagatgaatgtgggggcactttggggaggtattccttcactgagctcctgtctgctgtccagtctcatttcctgtttcatctttcacagctatacctcatggtggtagccaggtcctattactaacagtgcctgaaggcactttgtgtcaggattcctttcacactcattctcctttgaaatagccttactggcctgaggtaggagctgctgggagtgtctccatggcctccagcatctccctttaatacacttacttcactgtctgatgccctgggaagacagcatgcctctcgagaacaggaaccatggttttagttctctttgttgtcctagggcctcccaaggaacatggctgaggtttgctttggattgactgtattattagctaatgtaatatttacttttaagattttttaaagtcaaagactaattgcataatataatgacattagaacccaaaataaaatgaatattcccctttgatgttttaaagaatcatgcagtttcccatttataggttgtcataatcattattggaagagacgtgaactaggcaggaaagggacaatatgtgtgtttagccctgtgagcaggcgtgcgtggacgcccacacactcagcctccctcactctaccccaccctcgtatgtccctcctccttcccacttatacctcttcccccaacccctaaacttcttcaagttcttgattcaaaatggcaaaaccagtgaggcagcaatgtgtttgcccaccaggaccacgcttacctgtcctaggtttatctattgcagttaggtcagtgtttctcaaacatctttgaccagaaatacattatgtatatgcatatgcacgtggatatgcacacacacagtgaaacacatctcatgaaaaaatgcatacaatggcaccccccttagactttctgcacttgcagttactcacagtatagtacaataagattttgagagagatggagagatcacatttatgtaacttttttttttttttttgagacagagttttgctcttgtcaacccaggctggagtgcaatggcactatctcggctcaccgcaacctctgcctcccgggttcaagtgattctcctgcctcagcctcccaggtagctgggattacaggtgcctgccaccacacccagctgatttttgcatttttaatagagatggggtttcaccatgttggccaggctggtctcaaactcctgacctcaggcgattcacccgcctcgacctcccaaagtgttgggattacaggtgtgagccaccgtgcctggcctaagggtttaacaatgacaacaatacaataaatcaactgtaacaatatagtgtagtacataacttctattacactatattgttacagttgatttattgtattgttgtcattgttaatcccttgctatgcctagtttataagttaaactttatcataggtatgtgtataggagaaaacactgtatttaaggtttggtactattctcagtttcagacatcccctgagggtcttggaatatttccgccattgataaagagggactattgtattattattctgtgcagtccatgttcactatgctgttcatagtgaatggtgttcatgacccgagactggatttcataacccttgatgcttcttgaccagaagtttgaagaacattgatctaggccaatatcgatggcaggaaaaaggaaaagaaattgttgaatgaccttcatttgaaagcagtacccattgttaggggcttcatggatttattaattgctttttagaaagaaagaaatattacgtcctttaaatgtacatcgtggatgtaatacatcctcaagtcagaaatgtgagaaacgtggggaggtttatgatgtcgtgtgagaggcattgctcactttgagctgggcactgttctctgtgggctacataatggacctaattaattcttgatgacagtgttgcagggtagataattatggattagagtcaataagtcgctttccctagaatacaacactaagaagagccagaaccccactcctcatgtgactttaaagtccaccttctgtaatgttctgtccctattggatcacatcttgtgatcgaagtgttccagtcttggcattcccactagccagcttcacttgcacatacatattaattcagcaggtatttaccaagtgttgggttttttttttttttttttttttttttttttttttgagacaaagtcttgctctgttgcctaggctggagtgcagtggcgtgatctcggctcactgcaacctttgcctcccaggttcaagggattctcctgcctcagcctcctgagtagctgggactataggcacccaccaccacatccagctaattttttgtattcttactagagatggggtttcaccgtgttagccaggatggtctcaatctcctgaccttgtgatctgcctgcctcggcctcccaaagtgctgggattacaggcgtgggccactgcacccagcctacaaagtgtttttttgtgtgtgccagcccttaggaaaacgcggctcactgtctctgcccattaggagcttccagtcagggaaaaagagatacttaagcaggtcagcctgactcaatgtgatggttctctgaatgggagtagcagttgctgagaggaaggagggtttctcaggagagcccctgctggggcaaacttgaagatgtgattctctaagacagggcatctgaactcgtggggtctcatatttcttctttgtaaaagtaggagttcagactgatttattctggtgtccttgaacttgtatctgtctatgatctttccttagcaccttatctgcattaccttggcccctctgacaaccagaaacaaattctccatccctttctgtctcaacgcttgtattaccttttgaactgctcataaatttcagtttcctgttgaggtatgccctggctgtgagctcacagaggtggctgaatggcatgaaactccattagcagtcagatgttgcctgtgtcgcccctgttgtttgactagttgggcactttcttcctggaagggatcttttcttatggttttataatatcagaattgcttttttttgagacggagtctcgctctttcacccaggctggagtgcagtggtgcgatctcggctcactgcaagctctgcttcctaggttcacgccattctcctgcctcagcctaccaagtagctgggactacaggcgcccgctaccacgcccagctaatctgttttttttttttgtatttttagtagagatggggtttcaccgtgttagctaggatggtcttgatctcctgaccttgtgatccgcccacctcggcctcccaaagtgctgggattacaggtgtgaaccaccacgcctggcccaaaattgctttttaattacagtaaaagcaaacaattttcatcatggaaaaaagtaagtcatatgtagtgttcatggagaataggatcagaaaagggtaataaggaaggagggatgatttggaaatgaaaagatactgaaaagagaagagacaaaatagataataatggaaagttagagaatacctttttattcgatgatgtcctcagcataaaaatactgccttcaccttctgaaattctgatccattgcttctaactctgccctcacgattaagcatgacagctgttacctctcttcttcactattcactattcctgtataacaaatttctgccaaacttagcagcttaaaacagtgaatattgtcttaaaaatttgctgccttcatacttttaaactatagaattaaagtttaaagaattgctttagcttttatgtagaatttcaattccagatatcaaaaaataaaatacaagatggcaagtgtatgttgttatcttcctttcctttccactcagttttagaatccaaatttacactaagatgggctgtcagtgactgtccctgcagtgaatcccaggcagtttcccatctcacttaacatgccctgtgggatgctccagcctgagctcagggcctccagggaggagcctgacagatgccagcccctggagtgagtgctggtggcacttgtgaataacagtccatggctcatgtttgtaaattgcctaagcaaagcaaactgtaagctcattagcagtgcatttcagtgcattgactctgggcacagaaagtcacctcctacaggttgggtggaagtttctctggctccttctctttttttatttttctcccaaaaaataaaattttgggagaaaaataaaaaataatataccttttgaactaagtttgcataatcactcaacacctggggaaactcccagttttgggtattcttttagatttaagcttcataaactcataaactgacatttcctttctttttttttttttttttttttggtggtgaatgtctggtttttggaaatgctctccatcagattacattctttttaacaccctgctgcatgcgtaaggatgccattggatgcatctgtcacacttactacatgaagctaggtagaatttcttctaatattgaaactatgggaagcataacagtcacatttttaattagtggcattggttaaacctgaagaatcctagaatctttagtggttaaattatacgactcttgaaatgaactgatctcaggcaagccagtgctttataatgctttatttgagctcataaaagctaggggaaaaaaatgaatggcctcagaataacccctgataaagttttttcagagatgttagttattggaaaagcataagctatgtatgttcacagggaaaaaaatgggtttaaaaattactgttagcattatttagtttgtggataaaaatacagaagtcgcttactagagttggtattgttcttatttctttgttaatgaagtccttagaaatgctgggttttggccaggcacggtggctcatgcctgtgatcccagcactttgggaggccatggcaggaggatcacttgagctcaggagtcggagaccagcctgggcgacatggtgagatccagtctctacaaaaaatacaaaaattatccgggtgtggtggcacacacctgtggtcccagctactcaggaggctgaggtgggagaatcgctggagcccgagaggtggatgtttcactgagctgagatcatgccactgcactccagcctgggtgacagagcgagaccctgtctcaaaaaaaagagaaagattgggtttattagattgcagaagatgaggtggcagagagtactgattccaggcaccggctgtcttagcctcacctccatggccttgtaaagtctgaagttgctttgccctagctcgggtactgacatcttcagtttctaggccccatttttgtttcttaattgtgttataaaatcatccgctggaatagactcagtcaccacaaaaggagaaagaaagtagctcatcaagtagatgttcctgcaaaatgtaagatttcaaagttcagattttcattgcatgtttggtaaagttttataaagatttacattttagagtaaaagagcatgtaagagacttctattttatccaaagcacttggtactagaaatatattttaaaacaatcctttttattaaatttctttttaacaagtggagctattttggcaaattaaaaaattaaaagattaaatcacaaatactggctaccaactgcctataaccattaagttgccttagaaaggtcgaaattactaaccatttgaaatgtgaaaaaactgatcatgaaaaaagcccagttctcttagttctttccatcattctcgtttggctttaaaaattgatactgttacagaaaggaaattgaccacacaagagttaagtgatcccaaggccacaagaaggacaaaaccccacaaagttaagtttagggaattctgaaggacagctaggagagcaaagatagagtgagggaaaatattcccatcagcagaaagagaatgtgcaaagtatgatggcgagaaagcaaatgttatattcagggatacttgttctgtgaacttagtagtttgagattttcctaaatataatgtttacagtgtttttatattaatgattttttctgcttgataaaacttattaagttttcctttttgtagatgaaagccaaaaaattctaatatggtgcttatgttgtctaattaacaaagaaccacagaattctggacaatcaaaacttaactcctggatacaggtaagagagtaaatcttgctctgcacttctttgaattaaattgattatttaaaagtgctgcttaaaaaaattttggggtggggtggaatccagttctatgatgttttagaaactttttcaaacatacccttcactgttacattatcttgctgagtaaaaagtttttcaagagatttcaattttgcttgactgtgaattccaaaagataccagtctttaggatgaagacctaatgttgagtggttttgaaaagtttctttcaggtgattaaaataatgtattccatttcactctagcaattgctatccttcaaaaaattgtttttccctatcaacctggtttaaattcctttccacatgcttccatgcctctctcaaaatctattttgtagtgaaatgaaaattcagcagtgcggcgggagcagcactctttattttgtgtcccgaagttggtgcctgagccagcatatgcacagactggatcttggtgctgcgcggcctctgctgctcactcacactttccagttggctacctactgtgctagtccagatagctgacagctttctagatttccctgtctgcttctactttctcctgaagggtaggcataaggtagagatgtggtgaggctgggctgcagctgccctcaccagcagcgcattggctgttcttttctgttccccgcactgccttgctgcagcaaccccaggactggctgatgcctgtcagactccacttagtatgcttgtggttcagatcagctgcttagtattatgaaatcatccaaccagattagtgcatatggttttgtctatcagtctgactggtgatatcgttacattcactgctttttacgatttctttgttttagacaaaattgctaacagatgatgaagacagtatttatatttttctgtttgaaagatagaagggagtgagagggattgggcaatggaaggaaagaatacaaactttaattggaaggaaaattaatgtaaggaactgaagaaaggaacagataagtagaattagggaagaaagaatgtgtaacaaggctgaagaaacaaaatgacatatttagtccttaatttttttaattgttgcttttattatttgatattttaatgaatatttagcatataattttgtattagatagctcattgagtcctgaagtaggccatctaatgaagtgtttttagagtgactggattaactttcttcatttaactcatgactttattagcctgtttaaaaatttctagcctcacattttattgtttttcttgtttaatactatatctacttactagtaggtacttattaagtatagttcagggagttaaaacacttaatctgtgccttcggggaattcccagactggtaaccaggtcactccagggcagcgtggttgagttattgctaaagctgtgtttaggtgtgacgctgacgtagagggggacacttgctctgacaagggggtttggagacatttcctggggcaggtgacgtgttaattgaattctgaagaacagctaggagagcaaggatagagttagggagaatattcctgtcagcagaaacagactatgcaaagtatggtggtgagaaagcaaacgtattcagggaactgtgggtacttaagtgtgcctggaacttggggttttgtggagttggtgatgaagcatgaagccagagagaccagcaagcacagtccttgcatatgactatagaaggtttttatcttgatgacagtggggcagccaccagagtatttaaaacagagaaatcatgcctgggcgcggtggctcatgccccagcactttgggaggccagggtgggcagatcatgacgtcaggagatcaaaaccatcctggctaacatggtgaaaccttgtctctactaaaaatacaaaaaattagccaggaatggtggcacgtgcctgtactctcagctactagggaggctgaggcaggagaatcgcttgaacctgggaggcagaggttgcagtgagctgatatcatgccactgcactccagcctgggtgacagagcgagactctgtctcaaaaaacaaaaaaaaagaaaaaaggaaaaaaaaagccagagatatcatgtagccagtgtgagttttagagactaacagcaaaaggaagttggttgggaagagggcaaggatagacgttggaagctattgtagtgataagttgagaaattgcgagggcctcaaagaaatggagaagggggcccgatttataagatattaataaggcaaatacccagaaggtataatggcagattaaatgtcgatacacttaggcatagctggaaatgtacagagagcaggtgaatatcccattgccaggagagcaagctgatttgctggcagaggattgaaagtcagccacctgtgggaatagtggaagccttaggtgaggtaaggtccgctcccagagagtgctggggtaggggcccaggggaactagagagagccttggggagacactgaccttaaggggaagtggaagaatgattgatgctacagaatgtaaggaggggtccaagaagtagaaggagagaagcaacggagaatgagtgctcattcatatctaatgccatacagcagtgctgtccagtaggaataaaatacatgctgcatagataatggtaaactttccaggtgctgctttaaaaaacataaaaagaaatagttaaaattaattttaagaagatatttcacctaattcagtatattccaaataccatcatttcaacatttaatcattattaaagttattgagattatttataatctttttcatgatgtatctttgaaatccactgtgtatgttacgctaacacttatatctacgtgttgtatcttcattcagatgttaaattttctttggaaattcttgatctgtatttagattttataaaatgtagggttgaaaaagtagattcacatacccaagttgttccgaggaattttataactgaatcaagtatcggtatttaaattaaaattgaattaaaattaaatacaaagttcagttattccctggtgcttactgcacggcagtgctctgcagccacatgtggcaggcggccgccgtgttggacagggcagctgtggagcatacagcagaaggatcaagaaacactacttggatttagccactgtgagcaaagactcggtgaggagaggtttagtgagaggtggagggaaacagccagattgctccagattgagaaatgttgaagaggtgaggaagcagagataataaacttcactctttcaagaaacttggcagtaaaggagggagaactttggcaatgaagggggtgatagccagactagggtggggttggctgaattgagcaagtcccaaacatgctttacattgagatgaatatgtgggtagggaacaggtgaggatatgcgaggttgggaaaacagtttccttcctcagttaccaagcaagcctgaactaaataacatgaaccgataaaaagatgtctaggaacatattaatgatttaactcttaacaatttattaacatattaattatttaactcttaacaactctaaagctaattacattgcccatcatcagtcagtacatacataatctcatgttggctgtaaatgcagcaagatagaagatagtctgtaggttggtttataaatcagttcacatctccggtatacttgattttatcttggaggtgatattttcttcatggaggttttagagtgacatagtatctgttaaagatgtgtaccttgacatccaatatccttgtgaaaattataaaacagccatattttaatgtttgctaattcattcagcaagcatttattagggcctaccatgtgctaggatgttctaattgtggtaataaaatcttgggtcattctgtgttactggagcattacaagtatgattgaaatactctaaatcaaaaactaagaatttctacagtaaattacaaaattcagtaaacattcaaattaattaataaatttgaaaatgatagactgagttgtatttttagcacagagaagaaataattctgtttgacacttgacatgttagcatgtgttatactggaaacacattgataaaatgttttggagttttactgacaaccttgaatgtgccatcatagagcaccacctcaacagctcttcttacagttcagagacgaagttccgggactctttcatgtattttgggaatatgtggtcttgaaaaatgtagttttactggtaaatccactgaacagatactttttgagcacctactgtttgccaggcacaactatagaggctgaggatacagcactggacctagaaagacagtctgttctcagatgctacaatagatggggaaggtttccagggcctgccaaatgtaagaggatgcctgtcttctctggcaaaaccataccactattattttttgattctgatagaaagaaaaaaagacaaaaaaacacaacagggtaccaggaacagagatcaaaaggtgttgtattctatctgtattttctttcgaaatgcaatactaagcaatatccagatagcgtctgtcctctactttcttcttttttcaaaaagaaaaaacttataaattaaaaaatctaacagacttacacaaaacataaatgccaagcttaataaattgtgacagatccttgtaatcaccacccaaggaaatagaacagaacattgactgctcctggatgtccctgccccccatgtgccccttgttgctttttttttttttttttttttttttttgaggtggagtttcactcttgttgcccaggttggagtgcaatggcgcaatcttggcccactgcaacctccgcctcctgggttcaagcagctctcctgtctcagcctcccaagtagctcagattacaggcatgcgccaccacacccagccaattttgtatttttagtagagatggggtttctccatgttggtcgggctggtctcaaactcccgacctcacgtgatctgcccacctcagcctcccaaagtgctgggattacaggcgtgagccactgtgcctggccactttgtgccttatttaagaaatttttctgcagtccaaggtcatgaagatcttccatattatcttctaaaagcctgttggtttccttttcctatgtaagtctgtgatccacctgtaacttatggtgtggtgtaaggtggtaagtagtccattttcatcttatttccacgttgatgtcccattgcctgacaccgttattgaaaatcatgatctgtggtgctaccttcgtcatgcatcaggttcctttgggtgcatttcccactgatctgtggtgccaccttcatcatgcatcaggtgcatttcccactgatctgtggtgccaccttcatcatgcatcaggtgcctttgggtgcatttcccactgatctgtggtgccaccttcatcatgcatcaggtgcctttgggtgcacaggtgtgatcctgcatctctccattggttttgttgtttatttatggtattaatcttagtatcaacttgactggacacaaggtcctggtaacattattctgtgtgtttctgtgagggtgtcttggggtgagattaacatttaaattagttgactgagtaaagcagattgcccatcctaatacgggtgggccctatccagtcagtgagagacctgactagaaaagaaggctgatgctcccgagtaagagagaagtcctcctgcctgaaagcttttaaactgagacattgtcctttttcctgctttcacactcagactgaaacgtcacctcttcccgggtctaaagcctgctggccttctgactgaaactataccggtgactctcctggttatctgggcatttgctctcttgtgtctctgacttgctggctactgtaatggtgttagctgattccttataataaatccctgtgtgtgtgtgtgtctatcttattggttcagtttctctggataactgacaaatatactatatttatgccagttccacactgtcatcattaatgtggccttgtaagtatcttgctatccaggaggaagttcttccatcttgttcttcatcaagacagccttggctaatattggaacttagcattaactgttacataaattttaggatgtgtgtgtcaggtttcactaaaacacaaaataacttgttggcattttgattggcattgtgattagtcagtttggtgagaatctcaatggccactatcctctaaggcaaaattggtttttctcagttttgtttactattagcaaattgaacagtacctggcacggcataaatttttgaataaattaatgaatatatgatatgcataaatgaattaaaagttgtacaaatttattttttcagataatcttcctgataactttgaaacatttttgccaacttttaattagcataaccttttaatgaggctgatgattcgcttgcagaagtgtctgtgctaccatttcccagttctcttaggttgcattcatagtagtatttttaatctctgacttctttgcagggatcttttgaagccaggtgtccatctgatggttcctttagttagatagcataatcagcagaccttccttactggtcacatggagaccataatgcatatcctgagaggaagtgggaaccggagggctcctgccagccctctgtgaggtggaatccccacccttccctcagggtcccacttggactacttgtgacacatgaccatctataacatctagactggctaaggtcgtagtgtgagtacatttgtgaaatattaataaagcttgatttcttcttacatataaatattctaatgttgttttcacatctcagtggactatcttgtgcactacttggagtacacaccccaactttattaaccagtaataaattttgataaaatccacattctaccttggtatatgcagcttctcttcatcttttctcaaccctaatatctccattttccatttttgcatccacatatcatgaaggccactccctgatcttcccagatcctagcatcttgctgcactagctccagacatgccaaacctatgcacagatttgtacttggcagaaattttctttcctctccttggaatggttttatacccttactagcctggcctggctgagatatggaaacctagggaaataattattgttcaagtttgaatggcaatttaaaagggaaaataagatgattagtgaaaaatagcagaggcaaggtgaaattcagagatgaggccagggatgttagcgattcctcttccacagctccatctactatttttattacttttaagtaacaaacacattactgatattttttttctacctgcgttctatttgcttgactttctacaacctcagggtttttttttttaaagattaattgataattgaatttttgtatttgcctgtataggggatatttattcattgcttttccagtatccatctcccctcctttcccgccttcttaatagtaccctgaatttcccagctgtgcatgattcattctgggtgagaggtatcttatgtggctcctggagtgggtcctacctggcttaaccaacacagcttctctgttcctctggccacactggttggtcaagatgagccccgtcaaggctgatgagattcagggctgtaacatttgtttgcaagattgggaagtggattgtatctttcctgatgaacatgaattaagtagcacataatccctgaagttgctgttggtcatgtggaaccatgagatcagagcgtctctggaaatggagttagtcctgacaaaacatagctgagaaaaacagcaagagaaaacaggtcatattcacattgtgtggaccctggatcaagtcttttccaggcataaatgctcgaatttctttccttttctatttgagctgtttggttcaggattttgttactaaaagccaggagtgttttgagataacattgtttggggcataaaaaaacatttctttgaaggtttttgaaactcagggacacatggacacaattgcaagaaaaaaatcttatttattcaaggatgttatgaataaatagtgaatttaataaagtactttcagtttcttaaaaattgctctaatttgtatttgttttttcactgccattcattgtagaagatatatgcattcaataaggcatccttcttcccagcctcagttaattttactcctttgcacaatcctgaagtgagttcataatatatgtttgtcactgatatggtttggatctgtgtcccacccaaaactcatgttgaattgtaatctccaatgttgagggtgagtggggcttggtgggaggtgattgtatcatgaggatggtttctcacaaatggtttagcaccatccccctggtactactagttcttgcgaggtctagttgttgaaaagtgtgtggcacctcccttgtttctcttgctgctgctctggctgcgtgacatgcctgctcccccttcaccttccaccatgattgtaagtttcctgaggcctccccggaagccaagcagatgctgcagtgcttcctgtacagcttgcagaaccacaagccagttgaagctcttttctttataattacttcataaattattcattgcctccattactcagtctcaggtatttctttatagcaatgcgagaatggactaacacagtcagtcagcttatgctcatttccatggttgctgaaatggcatagacccaataattggaggtcaccacaagatcttggcaaaagagagagtggccttcaagtaatacctttattccatgttataacttaccaaataataaataagtttctttttaaaatatccctctctttgatttgcaccctcataagaattcctctttaggttaatcacgaactctgttctccacacttggaactttcaaatataggattgttgcaggacttttccctagttcagctaaggacggggttctttatcccatggccatgaaaattcaggcttgtagacaatttgaatggtgagtgagactgggttttattgggtgaaaaggaagaaaatggggagacaggggctctcgctagaccagagtccctgctggagtgcttcccgcctgccattcgaatcccagggtcctcacaggaagaggaggggccaggcgcctccctgctgcaaatgttgtgaacttcctgaggctccacctcagtcagtgggcaggctggttggagtttctccagggacccctgtcacctggctgtctcagtatgaccttgatgtatcatttttaggaaacgtgtttgcaaccaccattgaaaaagtaacatagtttggatattttatggacttggtttttactttctgcaaatattgcatatagatctcagaaaagtaaaacagaaggagataaactcatggtctaaaatagtatttggtatgacagtggaattcaaaggttcatacttgaaattgaacctaatgcaagatcagactggtaaaatggagtgaagttacaaaaagaaatctgataatgagaggtgaagccagctggacttcctaggtcaagtggggacatggagaacttttctgtctagctagaggattgtaaacgcaccagtcggtgctctgtatgtagctaaaggattgtaaacacaccaatcagcactctgtaaaaacagaccaatgagcactctatgtctagctaaaggattgtaaatgcaccaatcagcactctgtaaaaatggaccaatcagcactctgtaaaatggactaatcagcaggatgtgggcgggaccaaacaagggaataaaagctggccaccccagccagcagcggccaccagctcacttgggtcgccttccacactgtggaagctttgttctttcgctcttcacaataagtcttgctgctgctcactctttgggtccgcactacctttatgagctgtaacactcactgcgaaggtctgcggcttcactcctgaagtcagagagaccacgaacccaccataaggaagaaactccagacacatctgaacatctgaaggaacaaactctggacacaccatctttaagaactgtaacactcactgcgagagtccgcggcttcattcttgaagtcagcgagaccgagaacccacaagaaggaataaattccggacacaataaggttaaataattttgcattggaaactggttctttattcatccatgggccagatgcagcatagaaagcaaggtatgtgcttccaaagatatctcacccctgaaaggaaccttgagctctcgaaaccactcactggtatgaggaacagttagattgcactccaggtggtggtgtgactgcactgcagccgcactacaccgcacggaaccctggctcctcagacagacctctttcactaggctggaactgctggggacggcacagggctaagtcttcattgtggctttaaagaaatacctgcattgatttctgaatggcaaacttaaaaaaatttttttttttactgaaataattaaggaagcaaccatttaaagaggatttgtcagcttttcagacattatattccgcagagttgggccatgtctttttgttcatgttcttttttgttttgtgttgtaactcatagcaggcacaaaataaaaaactactgaatggataaaattatttaaaatttaataattcagaattttttcccttctctttttctaaaaggtaagactacccagaattttgttttattttgaactgatctgttacaagatcactggaaagagccatgaaagaattacaatgtgtgtgtgtgtgtgtgtgtgtgtgtgtgtacatgtgtgcacacaagcactgacaggtcctaagtccacatctccaggtcgaacctttcccctgagccccacattttcagctgcctgtgtgacatctccacttgggtgaccatgagtgtctcaaactaaacatgttccagattaattcctgatcttttccccaaaactttattctccctccaggcttccttaactcagttaaaaagcagcttcattcttcctgtttcctcaggtcaaaagccctggcatcatccttggctgctcttactctcccatctcacctcaagtctatcaatccatccagtctgttgattttatctgtgacacgtgtccagaatctgaccacttcctaccagcctcactgcttctacccccatccacgccactgttgccctctccaggaacattgcagtatctttgtgtgtgctctcctagagtctcaaccagaaggatttttttttttttttttttttgagaaggaatctcaccctgtcgctcaggctgaagtgcagtggtgtgatctcagctcactgcaacttccacctcccgtattcaagtgattctcctgcctcagcctcccaagtagctgggattacaggcgcctgccaccacacccagctaatttttgcatttttagtagaaatggggttttgccatgttggccaggctggtcttgaactcctgacctcaggtgatccacctgccttggccttccaaagtgttgggattacaggtgtgagccatcgtgcccagccaagaaggatctttttaagtgtctctgttcaggagcctcgggtaggttcctgtcttattcaaagtgaaatgcaaagtccatgcttggctcatgaggccctctgtgacctggctgtggggtgttactgattttctctcatattctcacttctctcagccacagtggcctcctcactattccccatgtgtgcccagcaactccttcctggggtttgggggtttaagcatctgccttcactgctcctctccgagaacaacactgctcctctgggtaccatttgggtcactgctggatgtcacctcctcatggaggcctgcctcatcatcctgggctagaccctcactctcttcgcttgcacgcggtcttagtgctcatcagctcctgacatgctgggtttttttctgtctccccattacctcccaactaagttacatgttccatgagtgcagagaccttcttgtacaggctaggatagtgcctggcacacagtaagcgttcagtgattatttgctgaatcagtaaagaaatgaataggaatttttgtggcaaaatgtggtgggatgaggagagggacttccacatggagaggagagaatggacaaagttgaccatggccaagaaatagtgatcactccagttaggctggagaatgaggtacctagagggagaagttaaggttagaaaaatagtttgggacgcattttggaggactgtgagtttgtttataaattaatggtgtgaggcaatagtgctgcgagagtgttgtaatgtggcacctgtcatgctccgcatgcccctgcttccgccctggctcccctcccatcttttcttcatcctccatccctcatttattccacaattgtatcctgagtgcctactgtgtacaagcaggtgttggggatggaaaggtcttgcctttgaggatctggtgattttattgcattttaccaagtgaaggggtggaacagcatgcagaaggcgctgaggtagccagagggaagggagagacactttgttggaggagtgcagagaggttgcaggggtggttaagaggcttccagaggggaacagttgagtttgcaacatgaagaacaaggccccaagtgagcagaggctgagggcctgtatggtactaggagacctgaaagtgatttgaggtgtaggcagagagatagctagaaacgttcttcttgctaatgataagaagaatggccatctcattaatcaaatgttaggtactcaagaaggtttagctgggcctgatcccaatgggccacttggcccgtagtaaagaattcacttaacttggaaggcaaaacttttaattgaaagggtttaaatgggggctgggggacacatatgtaaatataaatcagatggtggcttctttgttgaaaatacgttcagcacagtgcaggagggcaggaattggcaggttgagatgttggagaagtgggagtggagcagtggaggatagcgttaggttttaggagactaataacacttctgtcagtcgtctcctgtcttaggaactagttgagaataagataccagaggcaggcaattggacagttcctttacacctaaacagattcaagaatgtagcttgtgtctgtggtttggttggctcctctggatttagtagataaatccaccaggcactggtgagctgagcccccagaggcctacctggctgggactgagcctgcctggcccagtatggtgcagcagtaggccaggacgcatcctttctgcaggcaaggcaagttggaaagacaaaggaaaaaggacctatggcgggcagggcattttaaattttctctcccgaactgaccaagtagatcatttctcttagagaggagagagagtgggttgagagatgatgtcataggtcgggctctcaggaactctgactttgagatggagattagtgttcagggagtgctttggggaggaacagctatggagtagaaaggaaggagacaggactgtgcagaggaaaaagtttagctgcactgcagtctccacagaaccgtcagctgtgcctgtgggggtagaagcgagagacccctcagagctttcctgtgctgggacgggagggctggacctttgtagctctacatccatcagtccttgagatgtggccactatgggatgggggtgtgaccttgggcaaagcagagacagctgaatatgatatggttgtcaaatcacaacatccttcacagatattgcacttgttcctcccctgctttgccctcctggggagtgggtggacattctgtctttgggaacctgggcagtttattctgtcttctctgggaacccgggcagtttgtcttcctctaagaaggaatgccgaggttttgtggttgaagatagacctttccctgagaagtataaggggaagatgtggtgggatccatgacagaagtcactagaatgtgcgaaagggaggagcaggagacagcgcatcccagcagctgccctcactcctgtctgccgtgttcctgggcagctaccctcactcctgtctgccgtgttcctgggcagctgcccggggagacgctgtcttctcctctgccttcctcactgccttttggtgtccttttccatccctagagcatagatcagggactacaataaagttgaatccttttccttttcaccccctgtctattattgaataaaagtggctagtaacaggcatctgaaaaagagaaattgtggaaaatttttttatacttttgtaagtgtatttttcctggaggtttggaaaccacaaaagttttctgtcatactttattagggtagcagaattggtggtaggttctaaattcagcaagtacatttagtaaatccacaaaatgccattgctttcttaaatatcatggttttatttagtctgaaaattttttctcagcatttcatagttttgcagtgtaaatatggcatttagcatcattttacagggctctggaaaatgtggaaattactgttattcccattttcagtatttcaagtccatttgttgtgatcagtacttcattccacacataaggtctaattgtgaatttttaaaatgtctctatatgtgcatgttttgtgggagtggtagctgtctcctgagtcattaatgtgagtgcactgaacttcttaaacttcccattatgaaaatttgcctcccctaaaggggtaaaatgagataccatttgtattcctaggtaggttttaattttgtttggaagttttgttttattttgtttttttcattttatttacatggagttctgcttattataattctaattgtatcagattgtttcttagtgatttgccagtgctcagatgggccagatcaagacatctattgccaattaggaacaggatgtttatggtatttactgatgttctccggatgacctgttttatgttttcagtttgttttgttttatgatcatgttggcttttccattaaactataactttaactgagttggcttagttagtaaaacattgaccagctccccttctctatcctccaggccccttctgatgcctcttcccctattgtgccccagcctcagtctgaagggaagcgaatttttaggtctctatgttccagatgtaatctatatttccaagacataagctcactgtatttcaacctaaattgcctgagtaatgctccttggaacatttagggataaatccctgtgaaaagtaaatttaaacagtgacgtctgtagtgggaggtatttcttaatgaatagccactagtgaggatgtgtggatgtctgcactacacgtggctgcctgatcgctacatctgttttgaagttcagtgatttcccagaccacatgttcatttctttagggggctgacatccctcccaggatccagtcattgtgagctggtaactgtaactggcttactctttttgacctagagattattatactttgtcttagtttgactattgttcctatcagatctgacaatattggagtttctataaattagcagcatggcagaggaaccaagtgtatttaaacccataaatcatgatttccaggtcttttaaaagctgtgtggtttgaatagtactttactctatggtagacataaagagtggttataaaaattctggctaatcaggaggcttttgtagttcagctgaaactacaaaataacctcagatgcgtcactcctttgggaatcagaccatccagatttgtcctggctctgccagtgagatcttttacaaattacttaccctcattcctatatattaaaaaaaaataacaaatactatatgattccacttaaataaggcacctaaagtagtcaagtttatagaaacagaaagtagaacaagctggggagcgggggtgataggggagttgtttaatggatgcagagtctaggttttgcaagatgaaaaatttcaggagatctgttgcacaacagtgtgaatgattaagatgataaattttctgttttttttttttaaccaatcttcaaaaggatggtattactgttaactgaatgcttggtatgtgttatgcatgcattatcttgttaactattcacaactccatgagggtagatattgtcaccgtgtttataggtgagagaacttaaatggagtttactagctaggaagtggcagaccatgttgggcctagatgtgtccgtaaagccacttgaaaaatgtgttgccaccagcacacttaaaggcaggctcactctcgggctttttagctctagaatctgtgattctatgattctgagacacgccagggactttgcaaagacccatcaagtaggaacaaagtttaaatgtttatgtgttcagagaccacttctctactatttttagtgaatacaaactgccatattatatgtaatctgtggtacatcagcagcaccaaatgctggtttgtgagagggtgagatgttactgaaatgtgagaaaagttaaggtgtaaatagtaattacttcttttttttgttcgtttgtctgtttgttttccttgagacggagtttcactcttgttgcccaggctggagtgcaacggcacgatcttggctcaccaccacttctgcctcccgggttcaagcaattctcatgcctcagcctcccgagtagctgggattacaggcatgtgccaccacacctgggtaatttttgtattgtcagtagagacggggtttctccatgttggtcaggctggtctcgaactcccgacctcaggtgatccacccgccttggcctcccaaagtgctgggattacaggtgtgagccactgtaccctgctaatagtaattacttctatggaatggtttggtgaagactgagaagaacctcacctattcattatatttttcgactttttgagtttgtaataattagcttgtattacttatgttataggttgaatttgtgcccccaaattcatatgttgaagtactaacccccaatacctcagaatgtggccttacttggaaacagggaattgcagaagcgattagttaagatgaagtcatactggattaaggtggaccctaatcaacatgactcttgtctttataaagaggggaaatttagacgtagacatgcacacagggagaatgctatgtggagatgaagaaagagctcagctgatgcttctgcaaaccaaggaataccaaagactgccaggaagccccagaagtgtagggagaggcatttcctcacagccctcacaaggtatcagcccttaggacaccttgctgtcagaattctagtatcaagactgtgagacaaatttctgtggtttaagccactcaacttgtggtactttgtcacagcagctctagcaaactagtacaatttctaaaataaaaaggtttttattacatacaaaaaaatgttaaccatggttactgatagtttatccaaagcagtgttgaaattaagaaatgatctttatatgtgaagatgtttattgtaatattttttataatcagaaaaaatgagaatccaaatatctaggcattggtgaataaccaggtataacaaattatagcataactacttgatgaaatattgtatggtcattttgtatagcctttgaaatgtgaaaaatgcatataacataaataagctggatgaaaattttttatacaaaatgataacagttgtatgaaatatatatgcatcagactgaaattggaaggaaacacagaaaatgaaaaagctttgttaggattatggaatcataagtgggcttttttcttttaatcttttaatttgttgcttttattacatagaattgtggcaatgtattattgtgttatattattttttaaaaatcaactttattgaggaacattttacgtgcgatcaaatgcactcttaaagtgtataatttgatagttttgacacatgtatacctctttataaccaccgccacaatcaagaaacaaaacatgttcatcaccccagaaagttctctcttgcccttttatagtcagtccttctcccaactctggtctcagttagccactgatctgctttctgtcaccatagatgaactttttcttttctataatttcatataaacataataatatagtatatactctgtgtctggcatccttcattcggcataatgtttctgagatttatccatgttctagcttatatgtagctgattactttttattgttcagaatgttccaatggtatgttgtatccatataccagtttgtttatctgttcatttgttgatagcaatttggattgtttctagtttttggctatgagtaagttgctatgaacaatttttttttttttttttttttttttgagatggggccttgctctgctgctcaggctggacttaaacatctgggctcaagtaatgctctcacctcagcctcccaggtagctgggactatagacatgtgctcctaggcccagtttgaacattttttgtaaaagttttatatagtcatacattttcatttcccttggataaatgcctaggattggaattgctggattgtgtgatagtatgtgtttaatattataagaaactgccaaatggtttacattctcaccaccaacctatgagagttccagtagctgtacatgttcaccaacacctcacattatcagtctgtttttatcttagtcgtcctcatggatgtatagcagtctctcaaagtggttttggtatgaatttccctgatgatttgacactgatcatcttttcatgtgattctatcttcttttgtgaagtgtctattaaaatattttgcccattaaaaaatatttatcttcttcttaaggtgtgtaagactaccctttatattccagatactgttcctttgtcaaagatatgtattcagagaacatatccactcagttgtggcttgccttttcattttcttaattgtatactcaaaagtgcatatgttttaaatttttactttaaatttaaaaattttcctgatttgtcattttgttctgttataattcatgcatttttttctattataattcatgctttttatacctaaaaaatttttgcctatgtcaagtttatgaagattttctcctgtgttttcttccaaaagttttatgtgttactttttacatttagatatgtgatctattttaagttaacttttctagacagttatgaggtgggagtagagggtctagatttccatttgttctctgttttcttgttttagctcgttgaacataatttcagacagattttgtgtgtggctttttgtttttgtttttgtttttttcagatgctctgtcgccaggctggagtgcagtggcgcaatctcagctcccgggttcaagcgattcccctgcctcagccttccggagtagctgggactacaggtgcatgccaccatgcctggctaattttttgtattttttagtagaaacgggatttcaccatgttggccagggtggtctcgatctcttgacctcgtgatctgcccgcctcagcctcccaaagtgctgggattacaggaatgagccaccacgcccggcccagacagttttttaaaagtctttgtctagtaagttcaaacctgtatttcttttatttatttatttatttattattattttttattatgccttaagttctagggtacatgtgcacagcgtgcaggtttgttacatatgtatacatgtgccatgttggtgtgctgcacccattaactcgtcatttacattaggtatttctcctaatgctatccctcccctctccccctaccccatgacaggccccggtgtgtgatgttccccaccctgtgtccaagtgttctcattgttcaattcccacctatgagtgagaacatgcgatgtttggttttctgtccttgtggtagcttgctcagaatgatggtttccagcttcatccatgtccctacaaaggacatgaacacatccttttgtatggctgcatagtattccatgctgtatatgtgccacattttcttaatccagtctatcattgttggacatttgggttggttccaagtctttgctattgtgaatagtgctgcggtaaacatacgtgtgcatgtgtctttataacagcatgatttataatcctttgggtgtatacccagtaatgggatggctaggtcaaatggtatttctagttctagatccttgaggaattgccatactatcttccacaatggttgaacttgtttatactcccaccaacagtgtaaaagtgttcctatttctccacatcctctccagcacctgttgtttcctgactttttaatgattgccattctaactggtgtgagatggtatctcattgtggttttgatttgcatttctctgatgaccagtgatgacgagcattttttcctgtgtctgttggctgcataaatgtgttcttttgagaagtgtctattcatatcctttgcccactttttgatggggttgtttgatttttttcttgtaaatttgtttaagttctttgtagattctggatattagccctttgtcagatggctagattgcaaaaattttctcccattctgtaggttgcctgttcactctgatggtagtttcttttgcttgtgcacaagctctttagtttaattagatcccatttgtctattttggcttttgttgccattgcttttggtgttttagtcatgaagtccttgtccatgcctagatcctgaatggtacgcctaggttttcttctagggtttttatggttttaggtctaacatttaagcttttaatacatcttgaattaatttttgtataaggtgtaagggaggaatccagtttcagctttctacatatggctagccagttttcccagcaccatttattgaatagggaatcctttccccatttcttgtttttgtcaggtcaaacctgtatttctttagggttgtttctagaaatttatatcgttcctttgaaggggccatgtttccctgtgtctttgtgtgtcttgtgatattttgttgacaactggtgatttgaaaaaaaacagccaattctctcaatttttgcagactggctccatgtggggaaagaccttcagtagttagcccagtgtaaaggcctaaggtcttacacttttttggcatatacatcttccttggatttgtctgtctggttttttgtttttttccaattccgctgtatacatggctgctgttacatgtattaatttctctaagagccttactcctgctgcttcacagagactcagctgttctgctgtttttctctgcccataatctcttgcccacaggtgactgcagtttcctgcagttttcatgcactacagaacttgccactaccttctgcagccttcaacctgagatccaaagtgtcccagcattcccatccgaactctgagtcaggcaatgaagaaccagtcccttgggcagcccgcagacatacttttctctgtaatgagggagaaaactaggaattgggtctctttgtctctcccatgctatgccagggaaaggctagggcaagtgcaagcaagcacagcatgacatttcctatcgttttcagtgtggctttttcttgattgggtgtttgcttggttgctgcatatccttgacctgtttccacagcttccacaaaaccattttaatcagcatgtagttgtttgtttgatgtttccatggatgaacggagagggccatcctagtctgccatctagctaacatcaccctatcaaatgctgactatttttaaatgttttttctgcatctattgagatgatcatatagtttttcttctttatactattctagtatggagaatgcagtcactgatttttaatgttaaacctacttttcattactgggatggtccccatttagtcatgtaatgttatctttttaatatattgctgctatatgctaaaatgttaagggtttttatgtctatgttcatgagaaatattgatctgttgttttcttacagtgtctttgtttcgacatcagggtaattcactcttattattatttttttgagacagggtctccttctgttgcgcaggctggagtgcagtggccaatcatagctcactgcagccttgacctcctgggctcaagcagtcctcccacctcagcctactgtgtagctaggactacaggcatgtacctctgcagctggctaattttgaaattttttatggcaacgaggttttcctgtgttgcccaggctagtctcgaactcctagtctcaagcgattctcccaccttagcctcccaaagtgctaggataacaggcatgggccaccacactcggcctgcccttatttttcttccttaaatgtttaattgaagtcactagtgaaactttatggtcctcagattttctttgggggaagtttttaaattgcaggttccttatttttaaaataggtagtttctattcaggttctctgtttcttcttgagtcggttttaataatttttgtcatttaaagaattacctattccatctttgttgtcaagtttattgatataacatcctttaataatgcttttagtatctgtaggatatgtaatgatgtcttctcttttatttctgacattggaatttgtgtcttctcccttttttctcccccatgaactgagcaacggtttaacaaattaaatttttttaaatagccaggttttgggtttattgattttatctattgtttgtgatgtctttgatttttgctctttatgattttctttcttctacttactttatatttaatttgatctttcttaccctagctcttaagctggtgacaaatacttgctcagagaccttctttatttacaccatgagacttaaagctataaatttccctcagtcgctgctttatgtgcatccactgaattttgatacattgtgtttttatttaaatttagttaaaaaaaatttactaattttccttgtgatttctttttttgaccattggttatttagaaatgtgttttttgtttgttttttttttgagatggagtctcaccgtcacccaggctggagtgcagtggcacaatctggctcactgcaacctctgcctcctgggttcatgccattctcctgcctcagcctcccgagtagctgggaccacaggcgcccaccaccacacccggctaatgttttgtatttttggtagagatggtgtttcaccatgttacgcaggatggtctcgatctcctgacctcatgatccacccacctcggcctcccaaagtgctgggattacaggtgtgagcccccaggcccggcctagaaatgtgtttttaaattaacaaatatttgaggcttttccacatatctttctgttactgatgtataatttaattttgttgtgtctgattatatatttgtattatttcagtcttctcaaattcactgagaattgttttatggttctgaatttggtttgtttcagtaattgttccatgtaaacttcaaaataatgttgggtggaatattttctaaatgtcagttgggttaagatggttgataattatcgaagactgtggccggtctgagatttttttttccttcctttttggaaggtaacaagttagactgccactgtttcatgcatgctggctgaagacataggacttctgggtcagagacaaaggattttataatcacagcacagcaagccacaagagtttggtgtttgtatctgctcctctggtcccagaagacctatgggagagatgcagagagtcctagataaatactgtgcacatgtgggtttgtgtcacagctgaggaacctacagcttgtattgctcaaatcttttataataggctgcaaacaaacttcctttttcgtggaggaagacattattcttattgttggacagttagcaaacctgtcccatttcttctgaatgagaccctgtctcttttccaaaggggttggctgtacaaatatcattgaaaatatagtctggagcaaaagcagaaatgcagcagacccatggagaattgtctaccaataatagtgttgttcaggtccctatagtcttctgattttctgtctatttttatcaatctcctaagagatgatgttgaagcctccaattatgagttattaattgctattttcaattctgtcattttttgtttcatttatttctaagctctgtaactgtgtataaacacatttagaattgttacatcttcttgatgaattgacccttttatcattgtgaaatctttcttttttcctggtaatactttttgtttttaagtctgctttgtctgacattaaaacaacagtaacaacaataacagttttcttttgattactgtttgcatggtacatccttttacttttaacttacttgtgtctttaaagtgggtttttcataggtagcgtatagtttttggttttatctaatgtgacacctgctgctttttcatctaatatttaaaacatttctatgtaatataattattgatatggctggtttaaatctttaataatagttgctgttgttaagtaacaagccattccaaagttagtgaataaaataataatccttttaatgcctttttagattctgggttaggaactccactacacaatgtaattggcctccactgggaagacttgaatgctggcaggattcagcatctggggctggagtcacctccgtgcttactccctagttttcctgacgttagttgataccgactgtcagctggttcctcaaatgaggctgtcatctggaacccatggcctctacgtggggcttcttggcttcctaacagcataatggctgggtttcatgagagtgtccccaagagaaccaggcagaagctacatagccttttgtaacctatcctcagaaatcacagagttatactgtactctcttagcaggagcagtcatactaccccactcagattcaagggaagggatctgaaaccccacctttcggggggaggagtatcaaagatctttaacaccagacttcaaaactgccacatcaagcaccttgctatttgttttctatttttgtcatctgttctttgttctttcctcctctttcccatcctcctcactctctctccctatctccctctctccatctccctctcctcctctcctaccaccttcttccctcactttcttgtttctccttacctcttcagagaccgtataaactgctctctgctcccctaagagaggctcttgtttttaggaatttaattcttttacatttctttgcatcctcagatgcaaagtggtttacccattttatctagttattactgcagaagcagtgatctgtatccgaactgtaagagatatctttgtctttgaactggtaagtttacaccatttaattttttaaaattactgctagtttggaactcttttttataactaaatttattacttcaatttgacctatttttaatgtttcttttaaactttttatcatatatttttgtggtaaaatgcatataaaatttattatcttaaccatttttaagtatatagttcagtggtattaagtacattcatattgttatgcagctattactaccatccatcctcagaactcttttcatattgtgaaacagtacccattcaacagtaattctccatttcctctgccccggcaccaccattctacattctctctctgtgatttttgactactctaagtacctcatataagcggagtcatacgtttgtctttctgtgtctgacttactccactaagcataatgccatcaaggttcatccatgttctaacgtaagtcagaatttccttcctttttaggactgagtaaaattccattgcatgaagagactgcattttgcttatccattcgtctgtcagtggacacttgggttgcctctacagtttagttgtttgtggataatgctggtgggaacatgggtgtacaaatatctcttcaggatcctgctttcagttcttttaagtataaacccagaagtggaattgctggatcatctggtaattctatttttaattttttatatattattattatttttagagacaaggtcttgctgtgtttcccaggctagagtgcagtaatgtgatcatggctcactgtagtctcaaactcctgggctcaaccgatcttccaaccccagcctcttcagtagctgggactacaggcatgcaccatcatgctcagctaattttccaaatatgttttttgtagaaatagagtcttgctttgttccccaggctgttctcaactcatggctttaagcagtcctcctgcctcggcctcccacagtgctggggttaccagtgtgagccaccacacctggcccattttctgtttttttcatagtagctatcttaatgggtgtaacatagtatcacattgtaatagttttgagttgcatttttctaatgattaatggtgttgaacatcttttcatgtgcttgttagctatttgtatgtcatgtttggagaaatgcctgttcagtccatctgtttttcagttgtgttgtttggtttttattgttgagttttagttctttatacattccaggtattaatcccttatcctggtatatgatttgcaaatattttctcccattctgtgggttgcctatttactgtatctgtagtgtcttttgaaagttttaaatttcgactatttgatttgcctgtttttttcttttgttgtccgtgcctttggtgtcacatccaagaaatcattgccaaatctgttgtcataaagctttgccctatcttttcttctaagaattttatagttttaggtcttaaatgtaagccatggatgcattttgagttaatatttgtatatggggctaggtaagggtacacagttgcattattttccatatggatagtcagaatttcccaccatcatttgttgcaaaggctgtcttttccccattgaatgatcttggcacccttgttgaaaatcattcaaccagatatgcagggatttattattggactctgtattctattctactgatctgtatgtctgtctttctgcctggaccacactgttttttattactgtagctttttagtaagttttgaaatcaggaagtgtgagccttctagcttagttcttcttagggactgttttggctattctaactcttttgattgatggtttttactgtttcctttcatctctactttttgcttattaggcatatctttttatctcttactggctgctctagggcagcagtgtcctatagaaatataatgtgagccacaattgtgacccccatatttcccattagcaacattgaaaaactcaaaagaaagaaatgaaattaattataaaaatattttatttaacccagtataatgaaaatatcattgcaacatgtagtcgaaataaacagaatgagatactttgttctccttctcatactaaatctttgaaattcagtgtgtaacttgtagcttatctcagttcagacaagccacatttgaagctttcatttgcccatgtggtcagtggctactgtgttgggaagcacagctctaggatttataatattcatattttgcataatacatgactacaaatattacttgaaaatagagtgcataacatatgtgtatactattagaacctcatcacagtctacagccacatctcctctcccttctgtttatcgtggtggtacatttacttctaaacattttataaacccacagtatattattagttttaaacaaaattactgttttaagaacattgacaagtaaggaaaaaatcttttctgtttacccacagattctcccttttcagcactctccctttcttcctgcagatacacatttccatgtgatgtcactttccttcctcttgagtttctcttaccattgcttggagtgcatgtctgctgctgacaaattttctcagctttggtttctcggaaagaggccttatttcaccttcatttttgcatgatagatttctaattcgacaggtttttttctttgctatttggtactttaaagaggtaattccattcacctctgtcttgcatagtttctgagaaggctgttgtcatttttatctttgttcatctgtatctttttctacttaggctgcttttaagaattttttctttatcatagattttcagaagattgattatgatgtatcatggtatggttttctttgtgttcatcctagctggagtctttcgagattcctctatttgtgcatttatagttttcatcagatttggaaaaaatttagttatcattcctttaagtgcttattctgtcctgtaccccctttcctaggacttgaattctatcagtgttaacctacgtgagattttcccaaagatcattgaggttcttgtcataattttccccatctgttttctctctctgcttccttttggatagttttattgctatgtctttaagtttctaaagatttttcttttaaaaaaaggtttaaagaaagaatgactttaaatctttaagtctttctcctgaagtatttagtctgcttaattttgctttgtgtattttttatttcatatattgtattctatatctgtagaagttgtgactggttctggttttttttttttttcttaccattcatttctctcctgattatgtttttctttaaatacctataatacgtgtaattgtttaaggtctttactacttccatcatctctgccatttccagcctgcttccttaagctgcttttctttttggttatgggtcatattttactgcttctgagcatacctagtaactttttattagatgccaggtattatgaacattgcattgatgaatgtgttgattatgttgtcttcttttagagagagtgttgttttatcccggcagacatttatgttttgtagattaggtctatcctttccaagcttgtttgtaaacgttgttggggcaggtctatagtggcctttctccagggctaattttatctgccctttcatatgcacagataattaattttaccaaggccaagtagcatgttaaggtcaagtagcataacaaggtcaagtagtaccctacatatgcacagattattattcagccaaaaactcagagcccccatgttgatttctggagccttttctctatctagtttcctcttggctctcaaattgtagctatctttgccttatcagactccagtgttggtctccttaactcagtgaaacttctgtgctctgctcacgatggctctccagccctgattcagaaagtgcacccaggcagaaagccaggccaatcatagggattccctcattggtttttctgctttcaggatcacagtctggtgctgcctgttgtcaagtgtctgaagatattttgttcagttttctagttttctgtagcaggaggatacatataatagcttgctagggttagaagtcctgaagacaactggagtgctttaaaatcctttgaaaaaattggtaagccttcaagaaatttttaagtagtgttagaggttagtatatatattaatatgctacttgaccttggtaaaattaacatttttcaggttacaaagatctattgtaacctgtcctattagtatatagatagagtttatggaatatatatgacatgttttcagagtctccattctgtaataattgccatttgttaagattgttaagttgaaacaaattgttgggcatctagatcagatttaaaaggagttaaaccaaattgagactgaattttggaatggctatgccaagtactctgcaacacagctaattgcctgggttcaaatcctggtgtgtcacttactacttattaccctgggcaagtcatataacttttcgaaattacagttttctatctgtagtgacaaaataactttaccacctcgtaggattgttggattaagtgattatatatagtgtgtatgtgtatgtgtgtgtgtaaagcttttagaacaatgcctgatgttatgtgctcaaaaaatgttaattattgtcattgtgattgtcattgttagggaactgagtttctgattaaggtttattaagcctgaattttttttttaccattttaattgagacttctcttgcttttttaaccaagtatatcattttataatttaaaaaataataaataacacatatctatcatccagtgttaggaatagaatgttactgatatgttcaatatcatccacataactgtccctgctcacatatcctattctctcttcctatcttgaattttctatttattgtcaccttgctttcttaaaaatagttttgctatgtattgatttagtcataaataatatatattaatttttcctgtttctaaaattttatatagatataatgacatgtattcttctgccacctgcttgtttgcttgatggtgtatttttttgagatttgttcatgttggtgcatgtagtcgtgtgcattcatttgtaccagggtagagtgtgtttatttccaggttttgctgttacaaacagtagagctctgaatatttctgtgcatatttcctggtatacatgtgcaagagtttctctgggtatatgtctggatgcagacatttcaggttacaatctttagcaggctgctcgctggagcaggccagagtggaagtaggttattgcagtaggccaggcaaggggttatgagggcttgaaccagagtgattaccttggaatggagggaagcagatgaattggagattttgtctggaaatataatcaatagatattgatggtgtattttataaagggggccggatgagaaagaacatcaaggagactcccaggattttacatcaagttgccatttactgaaatgagaactgctcccaacagatagacatattttattttgttttaattcatacatgggcttttaaaaagaataaactttattttttaaagcagttttaggtttgcagcaaaattgagtggaaggtacaggtatttcccatatctacccattcctacacatgcacagcctcccctgttatcaacagtcccctccagagggatgcattggtcacaactgatgaacctgtcctgacacatcgttatcattcagagtctgtagttgacattagggctcactctgggtagtgtacattctatgggtttgggcaaatgtgcaatgacacatatccaccattacagtatcatacagcgtagtttcactgccctagaaattattcgtgctctccctgttcattcccctcttctccctaatccctagcagccagtgatctttttactgtatccacattttttccttccccagaatgtcctgtagttggaatcatagattatctagccatttcagattggcttctttcatttagtaatatcatttagtagctcatttttaaagtgcaaaataacattccattgtctggatatattacagcttatccattcacctaccgaaggtcatcttggttgctttcaagttttggaattatgagtaaaacatctgtgtttactaaaacacagatgctaaaaacatctgtgtgcaggtgtttgtggggacacaagttttcaactcttttgggtaaatatcaaggagtatgataggtggagaatatggtaagggtatgcttagttttataagaaactgccaaaatgtcttccaaagtggctgcaccatttttcatccccatcagcagcggatgagagttcctgttgttatacatccttatcagcatttggtgttagcagggttctggatttgggccattttaataggtgtatagtggtatctcgttgttttaatttgcatttccctgaggacatataatgtgcagcatctttttgtatgctatttttcatttgtatatcttctttgacgaggtgtccattacagtctttggtgcattttttaatcaagtagttttcttctagttaagttttaacagttctttatatgaatatgtctttttaaaatattttctcctactctgtggcttttcttttaattctcttgatagtatcctttgcaatggcatagtaggagataatatgggtgacttttctgttaaaaggtttatggaggccgggcgcagtggctcatgcctgtaatcccagcactttgggagaccgaggtaggcggatcacctgaggtcaggagttcaagaccagcctgaccaacatggagaaaccccatctctactaaaaatacaaaattagccaggtgtggtggtgcatgcctgtgatcccagctactcaggagactgaggcaggagaatcgcttgaactcgggaggcagtggttgccgtgagccgagattgcaccattgcactccagcctgggcaactagagaaaaactccatcacaaaaaaaaaaaaaaaaaaaaaaaaaaaaaaaaaggcttctggattagcagaaggcatttacagagtttaatactttcctgtcccttacctcttacctgcaaagtttattagaagatggatttttaacatctaggctgaaatactacagttagagccatttgtgtcacactcctgaatgtagtctagtctgtattattaaaattttaaaataaacaccgaaaagacagacacacacgtacacacacactcacccttcattcctcttccttaggatgaagtaaaatttgttaagttatattaagcctctaaacaaactgctttatggctccagcagctttgtgttgtttcttatctttgtaacattttgccacaggtacagtatataatgaaataggtgggggtggctagtggagaggttgtaacactgtcaatgagaaggcacccgggatttgtccgtctgacctgctcagtcagagtagtggagccacccggagttctagggagcatcagtctaggagggagatgggcaatgttgcatctcctggaggccagcacagttcaaagttggttttctgagtctcggtcttgtggttttaggattttatggcttttggtgggtatgtttgggaaggaagagccttcattccttgcttaacctgtgcaaataatcttcaaggactttgatcactgggcagagggataggagactgccatctgtcctccagatgaaagggttcttcttggcaggagcactacagagatggaagttgtgattttttggttgttttgactttatgcttctagaaaggatcttttaaaaaattcttatagctcttttgttttcttttcttctttatggtttctttcctttttagtgatagaagctgtggccagctcttcatgtgagttcacccacttgcccctcccaaggcaggcaccctgatatagaccagtttaggtggaggtttagggtcttccttgctcacctttgagccaggctgggctgccaatttctggctgagctgacttgacctttaaaaaaaacaaacttgatattatcttggctcctacagagaagacatgcagtgtggggctgggggctgggggtggagcagggtttggttgtactcccattcattagttcacctctttttctgagttcctatgctgggtatcctgactgacccttatacactgtacctgggataatgctcctggaaaagcatgtctttgcaaccccattactgtcatcatgaacaaaattagaatggaaagcaaatttttgttacaaaaaaaagtttaggggtaaacagacctgcagatttttacaactgctatgtttcttggtattcttctgtgtgtttaatcactggacagatgtaagggtgaattttattgttcccttggtgcatgtttaacctgtatcttagctatctgttaaggggtttaacttgggctgtatatcttctttaagagcttgaaagggaatttagagtggcatatctattttcattgcagcgttagatgtacggtaagttaagccatttttgtgaaaattgaaagcgtaatgttaaaagtgtccagttttttagccatttgtgcacattaaaaataacttgctatttatgttcagtggtttccttgttagacgatgtaggggacttgccacaacacatgcaacagattataaaaagactgcaaatttaataattacaacatggcacagaccgcgctggcagataccgagatccagcacactctttaatcatcatgcttcccatagtgtgggtggtcatggtccgcagacatttcaggcaggccagtcccgttgcaagagcacaagtaaacagcattccacaggcttttcaggatttttaatttgaaaaagtatagcatttcttttaggttgcttttcctttctccttcctccttctcccgcctcctcctctaaattttcgttgtttagaatgtttgctttttcagcaaaacctttttacatatgatgcttttgtgtatttctttttccagcttttatttggggcaacaaaataaaacatttcttaatactcctgaagcctgtttcagcacaaaagctgaaaatgaccggtaggatattttgctctttggagaagttagcaacttttcattataagtcctggtaaattgaatttaatcaatttatttccttactatttttttaaaatttaacttttaccgcttgtttcctttgatgtttgtttgattaaatgaaaatttgagtcatctgcaaagtttttcttcctcattcaaaaatgttgttcttgctagcctgttttgttcttctactttccatttttttgaagcttttatgatcttagtctttaatgttaatgaatattgataaaagaagcaagtcactagtttttgttgattaatgagaattatggagtttagtaaagctcttggttagtttctctcgggaggagttattttaagtaataaatgtgtacaaatggaaatgtatcattccgaagctttaacattttctctgaaagtgttttttttttttaaagaaaaacttggaaaaacacagatattttaataaagaacagttaatattacagatgcgcacctttctcttctttccttccctagggatttccttaagggatgctgtcttgttgctttaaattatagacactgttcctagtcttcatatatataattaaagacagttgtcaagttttttaaaatataaaatatgacatcttagctgctattttatataggcacacataattgagtaaaagaactatgtaaaaaaatactttaaatgtatatatcataagatacagtccttactaaagtcatagtatactatacctttttttacataagctgattaaaaatgaattgctaacaattagaatttataatgacattgtcaaaaccagcttaaagagaaagtggtgtgattatacattttagaaggaataacttccttttacaatcatacctgtatagaatgcagtgctatacataatttttggagttttgttattgttcatgaaagcattttaaaaatgctttagtcattttcatttgtgataaagctaatctaattctctattctgatgcttcttgccaagctttagatcataacagcttaatttaagacaaaaattgctggctaatcccctttggtattttgaagctattttgggctccctttgttctatggtacgttccattctgtttatggggagccatcgggtgtttgatgtgggaccctgtggcagaggagattggaactccagagtctgggtgcaactgggacaagttaaggatgctgaatttaacttgctcttggatttgtgtttcttctatataaattgaaggattacatttaattttagatggagtaggggtaaggcagattgggtttgattttcgaagtcaacatttggagtttggtaaccatatcaaaagcgaggattttgacagatttaattttcatattactggttaacatatacttatgactaagtgtttagtctcccctttcctgagcttcctgatgggtgtcagatttgcattaagacaccaaggccaacccgcctacacacaaaaattgtgttttgaaagttcttaatccctcatttcagactcatgttgtggttcccaccaagtgggctgcctgagacccagtggaagtttagcagatttctattcacaggcatgctctcagaacatctcccagttaccaatgcctaattaatgtccttgtgatggatatccatgggtctatatagatgaagcttcttgaactccattcataaaacagatatatagccatataatagacatgagtaatggacgcctagaagactaaatgttctatgtattgttttttgtggttccttcagtgaaattaaaggatcaatgttttacgtaagtttaaactactattgttgaaattattttactttcctggccttttgtctataaagaacacattagcatatactaaccgtgtcttattattggacacagtgcttctttgctcctggggatatttacagttatcccctccactctgtcctaagtgtaagtatacattgttgtgtttttgtgttatagattaacagctctgaaaatgtggtccaaggactctggggtcttcaagactatttcaggaggcctacaaggtcctcccttttccagctatgtaattttattatgctggattttctttataaattgaactaaagcaacatatcacaacagattgaatgccgcaacagataggagaacacagctgtcttctattgagacaaacattaaagagatttgcaaaaaaatgtaaaacagtgccactcaaaattttttgttttgttttggaaaacatattttttcataaataatatttttgttaacatgtaaagggttattatctcatattaattactagataaatattttaaatttttctgaggcttgattacaagtacagtaaatagtgataggtaaaaccaaaataaaaagtgctttgggatcccaagaccagaaaacttaagaactgctaatatatacaattgggattattgctgtggttctaaaatcaaacttccattggcttctctgagagttttagccaagtgagcatataaaatgtagtgaaattagcctgcggttacgaggttttaatgaactgtctccttcacattttcaggtgtttttttttttttttttttttgagacagggtcttgttctgtcacccagccacgaggctgaagtgccctccagctctgggctcaagcgatccttccacctcagccttccaagtagctggaaccacaggcacatgccaccatgcccagctatatttttgtatttttttgtaaagatggggtcttgctatgttgcccaggctggtcttgaactcctgagctcaagtgatctgcccacttcagcctcccaaagttctgggattacaaagtggcatgagccactgtgcctggcctcatgtgtctttttataaataaattatcaagcaaagctgccactgtcctcttgtaaatttaataaggagtcataggttttagagttatgatcccttttacttatttagctgatatttctttgcagtttgacataatctggacccatctgaattgtaatatgtgacttttaacaaacattgtagattaccatctttcatatgtgatctcatgccattcatggaatctatggcaatttcagtaaggatagaactcatcattcttgtgtatacttgggatgtttctaaccacatttgcctcagttacctaatattttttgcttttcaattgatttctagtttggggatgaagaagaaaaagaatgtaactggcaaaatagccattattttttgcctttattcttatttcacactttctatttttagtttatcttgctttgtaaccaatcctttagaatgtaattacttcttaattggaaggggctaactgccccacagaagaaacttctgtaattagaaaaagagtcccataacatctgatctggttctttcgccctgagcatatttgttggcaatttatggcaaggttgactcactggtgggaagctgcctcactcctaacctgtgctagaaaagctgcctcgttctagaggcagccctgcccctgttaagcccagttctgctgcctcactcctaacctgtgctagaaaagctggctctttctagaggcagtcctgccccctgttaagcccagttctgctgcctcactcctaacctgtgctagaaaagctggctctttctagaggcagccctgccccgttaagcccagttccctctgccctggcatctccacctctactggggcagtttccccagttctcttcccagccagcagcacccctggagccttccttttagtctccggtcacatgagtgaagaggaaattttcctccttctccgagcttaatacagcagttttatatatttaacattgtaggtgatttgcatggcaatgagcttattaggctgttttttgagtgctgccaaacacctaattgattttttcagttttcttccaagattatagttgtcaagaaccatctgccttatatattacattaaatgggttaaagctgcaaatgcttctttaagcaaaatataagtgtgtatcttatagaaagtaatgcaatatcaccagtctgaggtttggagtgtattaaggtacttggtttctggaaatctttttaagcttggaaacctttaaacctgcgacttaaaaaaggatctacagctatctaagtaggtggccttctgtgtcttggctagttttagagtgtggtgtttgtttcttacgcaaaaaggaacaaatttaaatcactaggtactcaaccaacagatttcagtgtggattagttaagaaataattgtagttcttgtgtggtggcacaaatttttttccctacattttgtttatgcagactgtctttttttccttcatccttttctttttttcactgaaaaaggaaatcgcaattttgttagtggattgctttgaagaaaatacggagggaaagagagaaccagacttgacttgtgattacttttcatgagtgtggataagtgtgggcttcaagacttgccaggccttcaattctttggcttgctttttttcttaacatttccaaaggttttgttagtgactttcaaatggaacttcacgccttggaacagttccattaaaaagttgtgtggtgttagccacagtagcagcatggtttatttttcctgtactagtttcacagaggttaactgagctggaaatgatgagagactagcagtgcaagcgggtgggtgtgtgctatgtgtatgctttttccctcttgatttgtgcaaaaaaaaaaattttttttattggcattaacgtgtacttcaaatgttgtttaaaaaggaagcaagtcaaattatcctaaaatgctttatactacattgttgaaaactttcaaaaatgttctcttttgttaattgtatttttacattgcatagtaccagcccacatttataaaaggcaattcattatagagatttgctttcttgatgggaaatgtactacagtttacagctcagcataatcttagttgacgtgttctggagagtgctttttatctgtctgaatttaaaagaacacttgactatgttcatgattgagacggttttattcctggttcaaataaatatcttgaagttaaaatatgcgccttttattccttaggtgagtatattttttaagaaaacatggtctgttatttatatgtcatccgcttgttatatgcataagttacttgaagaatagtgaatttctaatgaaaataacaattacattaatactttagattttaatgctgttttgtaaattttgaagcaaattcatatatctcatttaattctcacaacaacctcatgataccccagggcagatataattatctccatgttatagatgagatgagaaatgtaaggcatttgcctgaaattccccatttggtaaatgaaggagctggatcaagtcctcacatccctgactctgctcttcgtcttgccactctcccgtaaacagctgcttagacctccttgatagtttacaccatggcttgtggatggacaactgccataaaattgtttataacacacacttattgactgcttacaaagtttcgcacattttgaaatgagacttaccccaattaattccctcaccaactctctgagttaggaactattattatatccctattttgtggttgagaaaactcaggttcattagataggtgagttgagcttcctagggtaatgtagccagtaagtggtgggtactaatgtgaaccccagcagctttgctctgagatccagggtccctgactgctaccgtgcatgaactcccagtggttcatgtgccggattttcaaacgccaggtattcactggtatttgtaatagcatctgtttgcattcatctgtaatcttgaagatctgaccatgaaaacttagaaatgagaggtttatcctctgaatttacaccgaaataaaagaaaaattttaaatataaaatacatattattatcagtagctatactgcatggagcagatagctactaacttgtataaatcatcctaaaaataagataagtgtttattaagaaacaaagaaggttcatataagctggggaaattttttttatctaataaatgtcctctctgttgtatagagggttcttaaaatgtaaaacttttggggagaaatgaagtatgaaaggtttcacctaaacagcagagccattgtaccaaggcgaatgtatatacctttcagaactctggaagtcactactgtaaacactcatccttggactggaaaccaggagcctctggtggtagttttttctctgttcccccacccctccattcaacaaatggaatgcctgtgtgcgctgggcactgtctgtgctgtgctgggcacacagtggtgctcagatggttcaggaggcaaacagccatcagtcagtacttccttagaccgagagaccacgccctgggagaagggtggctagttaggtcatggcaaacggacatgaggtggtcttgctggagctgacaccggaagagcaattcgggctttagtaggtgaggagagggaaggggatgtaggaggtgagcagaacgcactgggaggaggcatggtgagtaggaggggcccaaggaggcagagagggctgtgggtgcagggtggggctgcagggtggggctgcagagtcaatcctgggaaggcttctctatatctaagcagcagcaggaggaaaggattttaagtactaggggtgaggtggggggcttcgaaaactggccagagtgcagtctgtggaacagattgttttaaggatttgatacatggcaaggtctaaacccattcagatccaacaccggtttttaataacagatgttttataatacctggttggagatcctgaaatgaaattcaaaatactctttcaaaaaaaattcatatattgcctttactacaatataaagaaaactaggtcaggcacagtagctcacacctgtaatctcagtactgcaagaggatcacttgagcccaggagttcctggccagcctgggcaacatagcgacaccctggctctacaaaaaaagtttaaaagttagccaggtatgctggcgcacacctgttgtcctagctacttgggaggctgaggcgggaggatcacctgagcccaggaggtggaggctgtaataagctgtaatggcgccactgcactccagtctggacctgtttctagtaagactctgtctcccctcccccacacacacaaaaaaaattttaataagataatgtacatttccagtgtaaatacttgggtcttatgagactgggagacatcatgaacggatgcatgcatctacacatgggctctctgagaatgtgaccactgcaaattcaggctgttagaggagggcctcatgtggccttgccttccaggaggtgattttccaaaacgatagacaactcttgataatgctatgatgaaactgctgtaaaatcttccctgaccaacagggtaattacattttcagagaagtcagaggatgccagaacatgcaaaacatattttgtatttctatgtaaaacagctttaggctctaaaagaaggttccacatacatgatgatacagtggaacgtctgaaaattgtgtgtgacagtttgctattatatggtatatttctagttttccttaaccactaaatgccagtaaagccacaaaaatgttttaatagcagattagtggattttgaattggccccatcaagagtcactgttgtgttctatagccctttcccacctaagtcccaagctaaagacagtgaattgtggtagcatttcagaaattccatctccactagctgctgggtcatgacgtgtgtctcactcctgcgagtgctggcttaggggcctttaacacctctgagccaagactctggcatggagccctttgcccatcctaggagtcttgagtctcaacccgtgattatattcttgattgtagaccttctcccctgatgagatcaaccctttctctagggactcctggaatttggccactgatgcctacttgactactatttttgggtcctgtggggacctctgctgtgttgttccacccactcagaagggctttttggatggcttcatcagttcagaacatgtccaggcttgagactttgtttcttggccttctgcctggtaactcctttatgtcaactcagggcttggcatcttggctgcagcagcagtagaaggtcctcttgggcccagcaccactggccttcctcaggagtcagctctgcaatttaactaacaagccacgattcctgcagactgtgagggccatgtgcaagataagcatgatgacagggctagatgcacagtacctggcagagaaagctttcagtacgtctcaactataactaccatacagttcctttattatattggggtttgtttgtttgtgacggggtctgattctttcacccaggctggagtgcagtggcacaatcatggctcattgtagccttgacctcccagacccaagcagtcctccaacctcagcttctcaagtagttgggactacagatgcgtgccaccatacccggctaatttaaaaagtttttttgtaaagacagggtctccctttgttacccaggctggtctggaacttctgggctcaaacagtcctcctacctcggcctctcaaggtgctgggattacaggtgtgagccactgcacttggctatagttggcttttttaacttgaggaccttgggccctggtgttcatggatgggcttcaaagggtcagaaaactccatgaaattgtgtggaaatattgtaggcatatatagttttcctggaagagggttcacaactttcatcaggtactcaggataggtcatgagggacttctgtttttagcaattgcaaactcagaaatcaagtgacacctcctcctaaggatgagaaaactcagactaaatatgaaaaatatgcttcaaagcttgaaaaagctcatgatatagtaaatatgttctcagtcagagtccagggaaaggtagaggccacaggaggtgagcctatggtttaggactaggggtgtctgccagttacaaaggagacgattaagcagcaaggtgcttttggagcatcacaggactaggagggcagaaattagagtccgtggtctgccaactgagcacatcctggtgaaccttttacttgaggttgggatcttgaagggaagcacctgaagagtaaatgtgaaccgaagcagacaggccctcagagagtgtgcagtttaccctcagatcatctcagtcactgaccctggattagggtaatcctggattgctagtgattcaggtgtgacagaagcctctttggaggacgacaatattatcttggtatctcaaattatttctgccagcagttttgcaagtgtagtgtcgtgtctggtgtagataaaaataactaggtatacaaagagccaggataacaaaattgaatcagtagaaatagcagacaataaaacagacacataggggctccagatattagcgttaagactcagactttaaaatattataaatcaatcagtgtaatccaccatattaaagaagaaaaagcatgtgattatatcaattgatgcaggaaaaatgcatttaataagatccaatacctattcatgatttaaaaaaaaaatctcccaataaattaatagtggggaattacctcaacttcataaagggcacctcccaaacacgtagagtgaatatcatatttaatagtgaaagattgaatacttccccccaagaccagaaacaaggcaaggagattcgttcttataacactggaagttcaagacactgttatcagtcaagaaaaagaaataaaaggcctgcatattgtaaaggaagaaaaaccattgctatttgcaaatgatataatcgtttacatagaatatcttaaagaatctaccaaaaaccaaaataaatcaattgttagaattgataaatcaggtcagcagagctgcaggatacaagatcaacacacaacagtcaactccatctccgtatactatcaatgaacatttgaaaaccaaaactaaaaacacaatatattttagagtcactccaaagaaaataaaatacttaggtatatacataacaaaatgggatctgtttaatgaaagttacaaagtgctgatgaaataaatgcttaaagactgaaataaatggagagatatttagtgatgatgcattgaagactcaacttagtaaagatgtcagttcttctcaaattgatctataactttaaagcatttcctatcaaaattctagcaaggctttttatattcataggcagacttattctagaatttatagggaaaagcacaagccctagaatagctataacaattttgacaagaaaacggggagaaatcactgtatttaatactaagtctttactgtgatagctgcaataattagatcctgtgatattgacagaggcgtggacacatagatgaatggaacagaacagagaacctggaaatagacccacacaaataagttcaactggtttttgacaaaggtacagaagcaattcaatggagaaatttcaacaaatggtgcttttgcagttggacatcaacctaaacctcacaacttatacaaaaattaactcaaatggatcagggatttaaatgtaaaatgtaaaactataaaacttttcaaaaaaaaaaaaaaggctctggaactaggcatagttggtttttttttttttttttttttttttgagacggagtctcactctgttgccaggctggagtgcagtggcgccatcttggctcactgcaacctctgcctcccgggttcaagtgattctcttgcctcagcctcccaagtagctgggactgcaggcacgtgccaccacgccaagctaatttttgtatttttagtagagacggggtttcaccatgttggccaggctggtctccatctcctgacctcgtgatctgtctgcctcagcctcccaaagtgctgggattacaggcgtgagccaccaagcctggccaaactaggcatagtttctatacttgctaccccaagcataatatgtaaaaagaaaaatcaactgtgttaggacctcatcaaaactaaaaccttgtgttctgtgaaagcccacgtgaaggacaatggcagactgggaggagatatttgcaagccacaaataacaaaggactagtatctagataatcaagaaatctcaaaactcaatggtaaaaaacaacccagttagaaaatgggcaaacactatttcacgaaaaggtgaaataagttcatgagcaaaaaaaaaatggcaaataaacacatgacaagatatttcacatcattagccattggggaagtgaaaaaataaaaccacagtgggctatcactacgcacctatcaaatggctaaaataaaagccagcgagaacttaaaatgctggtgaagatgtggaggaactgcgttactcatgcatttttggtaggaacatggctgtggatagttttgtacccaaggcaaatgctctcctgcatcttcttagtgccagccttgacaggctgcttgttgacttcttacagaagtaatggaagccaggagacagtgtaatgatatcttcaaattcatgggggtggaggaatccattaaaaatgagacattttaggtaaacgaaaagtaggagaatttgtcaccagcagagctccacaaagggagtactaagactgttcttcaagcagaaggaaaatgaccaaagtaatcctccatctccaaaaatatacgaaatttaattaatctagtttccatgctctgcctggcccagtgagttttggccctggctgcacatcagaattaccaatggaatttaaaaaaaaacacaaccctctatatccttcttcagttggtttggtgtatggctcagggtcactaatggtactggtgtgcagccttggaagtaacagggtggactcagaaggagagaagaaagtggtgtcatggcttaaatggaacacactgtcctcctggttcctgggcctcacctttatgcctggtatgtcttcctgtggcagcattcgttctggctaggctgaaatgaccctccgtagctctgagttctccctcttttgctccagtgagcaccaaatcccgtctatcacacctgtgtggtatttcacacttttatccttttctcttcattgccattgccgcccttgcaatttgggcaccctttacattttgactgtgatagctggtcagtggcaaaaaccgcagttacttttgcaccaacctgtagtatctcagtttccaatgtcatcttcctctttcagtttgtcttgcacagtcttaccaacccaatttttgtaaagcataactcatgctactgccccatttagagacatttttagtgctcccctccccaatgttcacaaaataatctcaaatttaatacttttgaaaacaaaatcaagttgtttacctattgaataccctttgatcacacccacggctcctgttaccacagcatacaggatgcgacatgattggaggtctgtttcgtctccaccctcatctcatagcactccttcttctgctcgccatggcctagctagagtctgggtttttccttgcctttgggctgaacttgccgattactccacaagctgtttgcatgctcttttcttacctttcaggtcttgatcccatgcttagtctttggagtagcgcccccttgcttatctaaagtgaatcgtatccatttctaatctaatcagcatgctcttcatttcttttattgttggtcatcttcatcttgttgacttctatatgtgttcgttgcctcttcccttttccctcactggaatgtaaaccccttgaaggcagccacctcaactcttgttggctgctacatctccaaagccaggtacataggaggtgctcaataaatatcccctaatctattttgaatatagatacactatagtaaagattttataacaaaggaactttctgacaagagaatcttgtttgttcagtgatttggacaatgtagtactatgtagttggttattgaaattctgcctgttcccattcttacatgtaacctttggatgaatgaagggcaggaaatgtggtaggaaatgaaaccgtataggaaaaagctgatgtctaggttggacaaagaagctggaaatagaattctgtcatttctgcaagatccaagagtctctactttgactatacctttatgtctctgaaatttctgtaatctttttctgttgcttcaataatagtaattttaaaaatttgatagtcaaattccaggtactgtttttaaagggacatttctagagacgttatatttaataacatatttgaatggtgttctatagtttgttcattcgtaattgcgttgaacagctccctgtgaaaaatgttatatcctcactttgaaaatgagaaaagtgaggccctaaatgttaagaaacatttaaaaagctagttaagttgggaaactgggactgaggtctttgaatgtctaatccagtttctgtgtcactactgggtttcccatccctggggcgtcaagtttcaactgaaagtacctgtggcaggaactggagatgtaacagacttgcttgtctctcaaatctgggaacaagtgaaggtgactaccaccaggtcaccttcacatagcaacacgatgtctacctggtgatgtccttggtcgttgtccctgctcctcctgtcgttggtcccagcagatgtagttgtccagcttgacatggctgaagcaccgtgggaatcgattttagatatcacatccaaggtgttcctcccattgttccctgcatcttcattcttaaaaaggaaataagtctcatcaaaagtattactgcattcagaacaactcacatttcttactcataaaaattgttttggccttaagagagatatgtcctaacattccctcctcttgctgccttatggaaaatggatctcgggggaggaagcaagaataaaatgagaaaaacgagactggaggctgtgacagcatgcaggtgagagatcatggtggctgggatcacggtgaaagcagtgccctggagagaagcagacctatccagagtgtagttgagctgtaattggcaggacttgcagatgggctgcgtatggaggatgagggagaggatttgaaggatgagtcgaaggtaacatctaaaatgttgactggagcaaccatgtggttggtagaatcatgttcttgggtggcaaagatgaaaaaggggcttggggatggctgggctaagaatcttagttgtgttaaatttgagataccaattgcacagttgcagatgtcaggcaagctagttgcatatatgatctggagcataggagagatggcagggctggaactagaattttggaaggtgtggtcaccctatagaagtaggatgctggccaggtgtggtagcccatgcctgtaattccagcactttgggaggcaagaggattgcttgagctgaggaagtcttggctgcagtgaaccaagatcacaccactgcactccatcctgggaaacagtgagaccctgtctcaaaaaaaaaaaaaaaaaaaaaaaaggaagtaggatggtgactggggctgggctgggctgggctgggctgggccttgtgaggtttgaaccccaccctgggccataggagggagcactcaggctttcttagtcttctgttgacctgcccagatgcaaggccgaaggggaagttggcctggagttcagtcttttatgacagaagaccccagcatagaaatggcatccacaatcatgggactgtacaaaatctcatggacttgaaagccactgtcctgacacctcaagactggagtccagcccttcatgacagaagacctcagcatagaaatggcatccaaaatcccgggactatacaaaatctcttggggtgcaacctttgtgacagaagaccccagcacagaaatggcatccaaaaccacgggactatacaaaatttcctggagtccagcccttcatgacagaagacctcagcatagaaatggcatctaaaatcatgggactgtacaaaatctcctggggatcacttgagctcccaggtctccagtgtctaaaaatggggttgaagagaaagtaccagctaagttagactagatgaaaagaaaaatgtgtagcatgcggtgtaccagcagcagaaaccagggccaccctgctgacctgctctggtctcacccacacagtgccagggcgggcagtgtgtgtgcatcctggagatgtacaggtgcagccctgggggagaggcagcccagggcaccgctgagtgggcaagcaagagggtgcaggggtggatcccacggtttgtagcatggagttctgactggtgaactggtagggatagaagccagattagagaagcctgaagaatgaatgtgagttgcagaagcaaagaaggcaagtttagacagctttctcaggaaattgtgctaaatgcagaacacagagatgaggagtaattagaaggagggagaggtaggatcaaggataacttttttctttttaatctaggtagctcttctagcatgtttgtaattgacatgagaaatccagcaatgacgcgggtcactgctgcggagggtcctggcgaggtaggagtggaggtgatcagggcccaagtggacagctgcactttataggagcagagacactccttccatctgaacaggagggaagacaggacatggggggtgtgcgtgtgcaggtgagcttgtaaattggttaaattggttggtggtgagatgagtgagtttcttgctaattgctattttctcaactacatatgagatgagctcctcaccaggacttttggggaaggggtggtggtgtgatgagagaggaagcaggaaataattactcaggaagtggccaagcaaaatgaccaaggatgcataagaagattgtgaggcactgctgagccccttcccttcaagggttgtggtcagaaatccaagccaacgctgtcagctcagttgtctgatattctccagcagtgttcagctgtgtgggcaccaggaagaaaagctgcagcatggattcacaagggccaaggttttacacagcaagtaccactggactttagaaaagggggcaagccagggagatgagggtgttttcaaagggatgattatttaagcctggcagaatatttatcaaatgcatgatctgctcctagtgaatgtatttagtaaagcacacatttccaggtctgtgtatctacatatttctgtatacattcttatagatacggtttaatgccatggtttcattcaggcttattttctaaagccttttggttttggtttttgggaagcctactctatttccccccccggaactaatgagcgagcaagcaagaggttctgtaagcaaaagtaaaagctgcagactttgttatggttggacctgtgtgtggaaattctgtgaattgtgttctgtcagcatcctgctcacggaataggctatgtaaacaacgggcgctgggagggtctgtgaatgagcagccttccttcccactcacagacttaaccactgcaattctccaggtttctgagtgtttatttcatagtaaaaagggctctaaaaataccagggcagttaggtttttattgtagatcatttcacttaaactgcaatgggacatataaattttaaaaagggaaaaaaaaaacattgaaggcaggattttgaagcaaaagctacagaaatgtgtctgcagtaatttgttttggctgtggatgtaaaactgcaaaagggatgggaataaatttgttccatttttttaagttagagcaattggcgtatttaattgatattcacagtatttgaatagcatcccagaatgcacaaataatatgctatcatgagaaaattacatatactgagatgtaaatgaaaggaaattctttttttgaacttaaaatatcatttgtaacttatgtgtaattttttaattaaaaatcatagggcacatcatactgtaagtttgagtatgcagagtgaaatgagaaaaggattcaggcagattaggcttgaggacaggaggcaaagccccaagagtcagtccaggtagggattataaatggcagggttcgggaggagtggacataaaaatgcgagagaacaggaaactgcaggaagtaacagttagtgggaaacaaagagagaagttactgagaaaacagacacaaacactgacgtgtttcggactgccatgtgaccaccactgaaggatgataaggtttactgagtaggaagatttgaaattatggacaggagcaatatgtaccaaggaaagcaaatattttgcttttcactggatggaaatttctcccttctaggaactcctgaccttctttatgggaccaagcagtgtaagttgtaggcttgtggttccttctgacttcttgtgtcttctccctaggggcaatgatggtgctggggtgtgatgttttcagtatgaagttgtgcttggaggcagtggcaagagccagtgggagcttttcatggagcaggctgcattaacccacgcgctgtgtgcctcctgaagctgtggcagtagtggcgtgacacctgccttcctgggagcctgggaagaaccccaggaagagacagtgaagattgcatctcttgtgggagatagaaaagagttcagtttagtattggcagtgataaatgcttgctgtgtaggcaaacagaatgatgaaacagaagacattaaagacctctttctccccctaattaggataggttctagacatttggcctgtgtcagagaaacagccctggcactgaaccatggaaactaacatttatttcgcacctactatgagccagatctctagccgggcgatttacatgaagacactgatgcgtagtgacagtaagtgagtttcttcactgagtggcagaactactcattgaacctaaatgggtctgactccaagtcttgagacgtttccatcctgaaagcgttctacctcaggtcctcaagtaatctcaccacacacggtggtctaggtcatgtctgcaccctgttgttggagattttgaaccagaggaaggggtcactccggcagaggtggggaggtcacaggatgacctgggcttccccctatgctgtcctctcctggttctttccctagtgcacaggagataaagacacacagcatttgagctatagtcaggtctgtggctggtgagccccagactttacagtgcagtggaaagggggtgtttgtcctgttggaagagcagattctagggcccacccccagaggtttggattcagtgggctgggtgggaccaaggtggtctgcaggataattcagattgaggtctctgtacatgacatcctgagaaacgctgacttaggccctccggttttcagtcttggctcctcctgggcctctgcatacatttgtggcagacctagaaatgatatcgtcaggtgagtgtatgtatgcaggacaggcattggagatgagccagagggcaggaggtgggccttggccgtgaccatgaagagggagaagggagaaggttagaggtatccagaacccaggaactggggttacgcagctctcagattatactccatgctcatccgaactgcgacttcagatacagcagcatcagatgggagacgtgctgggagtgcgtaacgctcgctgcttcccgtgcatgtgcctcactcacttctgtgaacttcctcaaagtcagttttatcatctacttttatggaattgaaaactgaggagacctaacaccgtttttaaaaattatcctaaggccaggcacggtggctcgcacctgtaatcccagcactttgggaggtcaaggcacctgaggtaaggagtttgagaccatgtggtgaaactccgtttctactgaaagtacaaaaattagccaggcgtggtggcgcatgcctgtaatcccagctactcaggaggctgaggcaggagaatctcttgaacccgggaggcagaggttgctatgagctgagatcacgccactgcactccagcctgggccacagagtgagactctttctcaaaaaaaaaaaaaaaaaaaatccaacagtccgagcgcagcagtctccccctaacctcaaaagcctcctcagaagtaacctggtatcagtgggctgtgcagattcttatagtcttctttgcctttatatatgaaaataactttgttttatgtttgttttcacataggtggaattatactgactcttactctgtgacttgctttcttcacatgacagtaactcctggactgtttctgtagcagccacacaagtctcctttatattgccaatatctatctttatcccaaagacaagatgaatgttcaaaaacggtaatccaaactcacttctaaaaatgggtgtgtgtttaaagaagagctgctcagctgaggcagttttgctgccgaggggatttgagcaatgtctggggacgtgtggttgtcacaacttgtgagggggctcctggcattgaggaggtagaaggcgggaatgcacaggtcaggcccctgcaacaaggaattgtcaggcccaaaatgccaatggtggcaacactgagaaaatgtgatcggtttaaacctgcttatcttaatggtgtttcaacagccttattaaggggcttgaccaatatgtagtttatcaacaccagcctttggtgtagtggggtgagttgtgctcctgttggagaagcagattctagggccccacccacagagtgcatacttgagaggcagaggtgtgaacattgcccttgagctcaggagctccacagcagcctgagcaacatactgagagcccatctcctaaaaaacaaaaacaaaaaagtgctgaataataagtccattttaaacatatgataagatttcagattttctgaggaaaaaattaattagacttggcttcttctctgacttgaaattagcaatacttttatacatctcaaagtgtggtttatgaaagaggcaaaattgtcaatgactacttgttgaattttgcttcctaaccatgtaatggggacaagtgtttccgaaaacatgttttatatggttagttttcctgcagatgggaattgttcgctgaattatactttgtccacttaggcttaggtagatatggattctgtgaaagtggaaatcattgaacagtttaaatactggattaaaagaaaaggaactatggtaattgcagatctgttagatggaatctgtcgtgccctaataagagtgataaggaagaccattaactgttggaagcaagttgttgggttcgaggttgggaattgggcatgatttgtttcctgtgtcactgcttaggttaatttactcagactgccatttttgtgttggaaggaaataaggtctaggccctaagcttagactgtcttcatgcctaaagaagtccaaccattcattattacttcgctaaaggatgcattaacatgaatatatataataaagataatgactccttttttctcaacaaattttaaattaacttaaacatgcctgattttcagaaagaattaaaagtaaaaccatacctttaatttaggactgacttctgcatttcgattgtagattattctaatatgaagagtgctatttgcatgttggaatatcttttaattcttaatttgtaagttacaaagaaataggagactgaaatactttttatcttacaaaattccaaataccttttcaagcaatttatatcttatttctataatagttttatcaccagccaatgggtatgcactgtatgtcataatatggaaagaaattctttatcatttcagatattaaggatttcagattttaagagttatcagtgaaactgtgttacaagaatattttgttcctgagacatctcagtattataggtggcttcagactaacaggcacagaataggatagtgtgaagtatctgattagctttactgtacttggtacctttaggacgttcagccagaggtgattggagggatttgcacgtctaccactcgtgtgtgtatctgtgaaccatatctcctttagtgcctgcttttgaactttatataaacagaatgatgctgcctgtttatttctataattttcttctttcccttagcatgtgctgttcttggccccttgcttctccatgtgaattttggaaaagcttctgaagttccaccaaaaaccctatttggaattgttactggtactgcattgagtttctatgccagagaactgacatctttgtgacattgaatttttcttgctaagatccaaggtcttcctttatgcagacctttcacatgtatttttaacagttttgtaacacgaatcttctttgctgtcttgtcatgtaatgctttgccggggagtggtggtccatcttactctatagaggacatttctttctttttttagtgaagtaaatgtaggtggtgcttatgagttgttttaatttctagtttgtctttgtttgcagggggaagtgataatttaaaattgtgttgtaagaaaattggccaattttcaccatggtatttaatttagaaaaatataagtcacttgcaggtaatttagtcagtttgggcattttgatattaagtaaacaattccagtataataacataaatgctttcctagatgtttacatataatgccataattatgtaaataaataaaattcatttaattacattaaatttttttaatgtttacattaaaaaaagggggggagaagcaactaattcagcattcgggcacaagtattttatatggtcatggtcagagagccctccaggtattcgacatggtagcatggccacaggcccaggactgaatagactggtttgaggaaagagaaggttaaacacactgatttatacctgagaaatacattttggtgggccaaaaataattgagtgtatcggatggaactaacaaaagctttcttttactaaccagttttgcaggaaaaacatgttttaaaatatgtagatatgcattataacttctatttaaatacagctgaggttgaatttctcaggacccctttcagcaaagatggccctttgcttctgcttttcctgtccgtcctggatgttctaatcccagcacccgaaggttactgcaagctgagtggcaccaaagcaacaccgtagccaatgaaagtacatcatcattggtgtgcaggttctggtcagtgttaccaacatgagttaatatctttgaagtaaaagcacatagcgatgtcatgttttcccagtattctgtgggtattttatgacctgcaacttaggaaagcaaattgtgaaaaagaaaacttgttgtgttcgcctataacaaggtcacaagggaatcctgcagcgattatgttcttcactagctgtaagagagcaatctgtgctcttggttttgactcagctggtctttattgaatgactattgtgtggctcccagctgtggtaggaatgtgaaggacagcgaggcagtgcctgccgtggagcgcctgcatgctaacggtggacagaggagagcaggctcaccgttacactgcaaggtgaccttggaaggtgcagggagagaaacacaagggaggaaccacagagactccagaacaacatcttgcccagtcaagaactagaacaggaatcctagagaaaggtgaattttgaaagatgggtatgattttggcagctagagatgggggcggggaggttgttgggtttctcagaagaaggaaaaggtctggaggtgggaaggggctgggtgaatttggtgaccagccaggagtctgatgtcaccaagtcacagggatgaaagagaaaggcaggggaagtgagtttgcgcaggcgggctgaggccatgtaggggcaggctggagtaggggccgggagccttagggggtgacaggagaggttttcccaccttttttctctactccttccccagtcaccttcccctgtcccagcgacatcacacatgcattctttctgtcttccccttgcctctccctcctccactttgtcttcttccccagccctcagaatcagttcagatgccattgtctctggaagtaccccagaacccagcagttggaactcatctctccttgctctgttcccacagcggctgcctcaccaagagtcattccagcactcagcaagctggctcacgtgatggctattcccacctgcagcacccttcaccaggctgcagggcttctcaccccagtggtcccaggagagtggcttgaaagcagatcatcctcaacctgtgtttgttgaatgaataaataagggatccctatttataagcacgtttttcttggagatggagtctttctctatctcccaggctggagtgcagtagcgcgatcttggctaactgcaagctccgcctcctgggttcacgccattctcctgccttggcctcccgagtagctgggactaaaggcacccgccaccatgcccagctaattttttgtatttttagtagagacggggtttcaccatgttagccaggatggtctcgatctcctgaccttgtgatccgcctgcctcggcctcccaaagtactgggattacaggcgtgagccaccacgcctggccaacacctttttttttttttgtatattttgtataaagagatatgccatggagagcaaagtggtggaaattctaaaagactttaatgatcagatgaagaaattgtttagagaagcataatatacgtgctctgtcttagtttgagaatactgaccacagtttggctctcctagccctttgcctgagcaaaacccacaacccttcctccacacccagaccatgttccaagccacaacccattgctccagctttcctaacctgcctgcgaatgtgctgcctgttacacgagggagcagatacagtgaggcaaggacaactaacagcacccaaaagcaagggcagtggatttccctctgctttatttaaaactccccttcttaggaaagttcactcgcatgatctaagcacattcaatggcttttcacacatgagcagagtttcattcttttacatgaatcgaaattgggcttaaaatcattttagatacagccatcttggttcccatactttctactcatgaaagattttatatcagtggtcaggatgataaaatctgtacatctttatgtctgaacctgttcatttatatccacatccttttcttaaatactgatttgtatatttagaaactcagtgcttcattagtaaactgagggagttagagtaaaggatctccaagatcactctgccagcatttgagaaagaacctattattatatgactataggaatttatttttgtccaagagccaatgcctaatctttaatggttttgtgtttagactatttaccactaggtggcggtaaaaaaaattattcttagcaatgagaaatgctcatcaatatttaagtttactataaaataaaaatttagaggaccaaagtttgaggtgtctgtttgaaaactacgtaaccatatactggcctctgtatgttgtttctaggacttaacacttattttattcagggaaaaaactcttgtggcacttcatagccacttatattacagaattatggaaaaacgtaaattaaaatatgtaattttgtttcatacacacacacacacacacacacacacacacacacatgtgtacgtgtgtgtgtgtgtatgtgtatatatagagaggagagagaaaggttaggtacattcaaggtttccggcatccactgagggtcttggagtgtatcccttgcagataagtgagatactacattttcatttttccaggacattatatgttaaagtcagctcgtgcaatgcagacattggaagtttagtcatgtgccttataatgacatgttgatcaacaacagcctgcatgtacaatagtggtctcataagattataatggagctgaaaagtgtctatgacctagggacatcataggtgttataatgtagtataacacattgttcacatgtttgtggtgattctaggtaaacaaacatcctgtgctgctagtcatagaaaaggataacacatataattatatatagtacataattacttgataataataaatggctgtgttattggtttatgtacttaacatactatactttttgttattttagagtgtactacttatttaaaaaaaaaaaaagttggccagatgtggtggctcatgcctataatcccagtgctttgggagaccaaggcagaaggatcactttaggccaggagtttgagaccagcctgagtgacatactgagacctacctctacaaaaaataaaattaaatttaaaaaataagcctcagcttattcagtctcagctacttgagaggctgaggcgggaagattgcttgaacccacgagttgaaagttgcagcgaactgtgattgctagcctgggtgacagagcagagcaataccctgtctcaaaaaaaaaaaaaaaaaaaaaaaaagagttaactgtaagacagctttaggcaggtccttcaggagggattcattccagaagaagacattgttattacaggagatgacagctccacatatgttattgttattgcccctgaagaccttccagtgggacaagatgtggaggtagaagacagtgatattaattacctgaccctgtgtaggcctcagctaatgtgtgtgcttcagtttttctctttaatatttaaatttttattgatacataatatgcatacagaagtacatgcacaaagcattaagataaagctcagtgaattattacaaggcaaatacatttttgtaaccacaagatagaatcagccttgttcatgcttctgacatccactttcttccttcttcctctccaaaggtagccaaaatcttaagagctaatgttatggataaactttgtctttttagacaagtgttttattacagaacattttaaacatatacaaaataaacaaaatggtgtaatagacctgacactcagcctcaacaactactcatcatgtgctatttctgcttcatctatacttcagctcattccccatccctttatttttttatttttataagataagatgtatgtgcattgacatgtataatctttattgtacctttttgacaaatcagtacacccatataactttttatcctcttaagaatagaataccggctgggcatggtggctcacacctgtaatcctagcactttgggaggctgaggtgggcagatcacttgaggccaggagttcgagaccagcctggccaacatggtgaatccttatctccactaaatacacaaaaattagctgggcgtggtggcacacacctgtaatcccagctactctggaggctgaggcaggagaatcacttgaacctgggaggcagaggttgcagtgagctaagattgtgccattgcacgccagcctgggtgacagagctagtaacaatcattaatgtgcatatgaatcacctggaaatattattttaaatccagattttaatgaaataggtcagattttgataaaataggtcagggttttgtctgagagtttgtatttctaacaaagtacagattcatagagcacatgctaactacaaggtctcttttatctaaagtaaataaaatttgatgaataaactaagggaaattgaccttagatgaaagaacacatcaaaacacatgtgcaatatgctatctgtaggagcatttggttaacgagcataaaccaaccaagcaattttataattattttaatccaaagttagcgaaatctctattatggtttccatggaaatgctccttcaggctaagaaatgttagtatcaccagagggcactggttaaaaacaccacagatttggaagtcgatgtcttataaagtaagtgacagacccctctttacacccataagtggcttttacagagttacccaaaattcagtcatttgtacaccaagtgtagataattttcatagcttcctattaaaattatattttaacgcccttacaaaatttaactcaattttcttataaaatgaaataacatttttatatgacattgttattcagcttaaacatacatacttgtattgggtgctgtgtccgtgtgttgaccacccagtgttctttggggttccactctttgcacaggcaccacagctggagaaacacagacgcacagacacaagctggatcctgcgtctcttcctgcctccgggcacagggcgccagtcagcctggttgtgcgaatggaggtcgtgttccttagcacagagggactcattccagggcgctcccctcagaggaggaagagaccggaaggtcgttttagggggcacttcctgggacatgggccaagcctcctaaggagtgagggctccaaccagcaggtacagacctctcagaagtcagggataaggcggccattctgaacctggatctccaccaccccttgtcccatctcatcaagacagttctgaggggctattctggcacatgtctggacgttagaggctggaggacaatgtgggctttgatgggattcagataaggtctgttccagggaggcaggaggttgatgctcagcatctgggatggtgtccttgtggacagtgagttgcctctttgggtacaagtccattttcactacagaagagactagagcaggggtgtccaatcttttgactttcctgggctacattggaagaattgtcttggtccacacattaaatacactaacactagtgatagttgatgagcttaaaaaaaaaaagcaaaaaataatcttataatgttttaagaaagtttacaaatttgtgttgagctgtgcactgacaagcttgggctggagagtctgaacggctccccgatcccctctctgattctctttggcagcaaggccttgaaggggctgagtctcagtgtcttgggggaattctggaaagcctgtttgggaacctgagaagacctcttgcctggagcttgaatgcttgatttgctgtcctggccacatgcatgcttggcagccagagagcggggtttgcattcacaccagcacaacagtgagccaggggttgaagtgaccaggacaagtgtctgggtggcagtgtgcctcagtttttaacaaaaaagtttaaaaagtaaaaaaaaattaaaaaattaaaatagaaaagcttatgatataaggatatagtgaaagaagatatttttgtaccgctgtacaatgtgttttaggcaaagcattgattgtaatagtccaaaagttcaacaaaaataaaaggtttatcaaatttgaaagttgcggtaagctaagaatagtttattgctgaagaaagaaacaagtttttaagaatttagtgtagcctaagtgtacagtgtctgtgaagtctacagtggtgcagagtcatgtcttcggccttcatattcactccccatttactcacccagagcaacttccagttcttcaggctccattcatgggaagtgtcctatacaggtgtaccattttttcagtgttataccatagttttactgtaccttttctatgtttagataggtttagatcacaatgttacagtattctgtacagtcccatgctgcacaggtttgtagcccaggagcaataggctctcccatgtagcctaggtgtgcagcaggctgagccatctgggttcatgtaagtacactctgtgatgtttgcacgcaaagaaactgcctaacgaagcatttctcagaatgtatcccagttgctaagtgatacatgactgtaatatctagggaactatttgtggctattttaaacattacttaagaattatttacaatctctcatctcaccctctgaatctatcaaatgtcaagacggagctcatacagtattgggaagtcaccctccgtgagctggtcccaggcccagggtgtgagtgcttctgggaggctgtgggttaggggaaagcctgggcatggttttgtttaacatctacaatcttaactgacccttagctgttactgctcaaaactggtttccttcaattacatactacattactttccatctcaaccaggtttgtagcgccttgcgctctaattttttaagggtggattgtgatatacaataacagtagccacctgtttatgggtggcttaattgaaactttgctgaattgaatttgattaaaaactgagcctgggattttcagtgagatgccacacttagagaacatagtgcctcacacattgtaagcacttggtaaattgtggttgtcacaattgctagaattccttcaagaagtcaattctcacaagtgaggggcataggagagctccccaggcagaggggattggacatactgaagtcctgatggcccaaaaagcctgtggccctccagggtcgcaaacaggcttgtaaggagaagtcaagcctggtggcgggtgtggggtgtgctggtgagccaggctgcttcactttgagaagtttgggcttcacagtaagagtaactggaagctgtaagggtctcagactgagagcattcagatttgcattgttaaaaactatcccaacagtctcatggacagtggatacagggaggttcattataaggtttggccatagagtaaataactagccttgggcaggctgcttaaactgtcttgatttcctcctctttaacccagattcagtaacagtacctacccgtaggctgtgaggattaaatgagttgctatttgtaattggcttagaacagcccctggtgtgtagtaaatgctttaaatgagtgttaaatagaatgcaaaagtctggtttctgagcagaaggttgcattcttctgacactgccctcccctcacctagcatcagactgacctgctctgtgcaaacccagactgctgccgacttggagcccacctactttccaaaccaagtcctcccttctctgcctgggtctgacttggacacctccgcgtggatttgacatatggctggccagacctggccgggctttcccttttcccagaacacctgcactgcaccccactggggattcaggctccatcctggcttgctaagagcaccaagtgctctccctgctgtgcaggccccaccctccgccttcgcaagttcagtggagtccagcagtaagcgcagctggcagtaagcacttccacagatggcacgctggcttgtacctgagctccctgactctgcccacccagccatggctgctccctctctctcccagattgcacttggtgttggaagagaacaccaccaacatggagacgaactctcttggggctatggtcagctcctatttgctttctgtatttgcggcagatttgaactgaaagagggaaaaaacaataacaagcaagtggccccatccttctctctaccttaagcaaggttcactctaactctctaactctgtaaggttcctgtttttacccctttccagtggattcatttttttgtaaatcatgtagtacatattactgggggttttttgttgttgtttttaattaatcatgaacgtcttctactgagtagtaatgttttaaagctactttgttaacttgcaattctaatttgaaaactgtagataggatgtcatgtagaaatggcaggtttccacttacatgacttaggagtgttgcctggattctcttttaaggatacggaggcaggggtgagctcacagggagaaagtacatgatctgcacaaaaggatgcatcccagattcagggtagagtttcccccaggggtagggctgttgaatcatgatggggaagggcagagggcatagaaggcttcttctgtatttctaatgtttactgattaagcttgaaggtttgtggaatttgacataatattttgtatctttttggatgtgtgagatactttatgatgaaattgaaatgaccaccgtgataatggtaaccactcagagtgtcactggtatgtgtgccacgtgcttgtcgtcccgggtctatggagcctgcctgcccatcactgaggcacccttagcctccaccctggattagactgtcatctccaagtatttgtgtatgaagttacatacatacatttatatgcacagatgcaaattcattttatcttgtaatgtgttatcacaaaatgcagtataggacttttttaaagatcaaatatttccaaataaaactttttcaaaaaatatttttcctggtagtaaaagaagcacatacatgtatggaaggctaggaaattgtacttaagtagaaagaagaagaaaaaaaatatatatatataatgttaatataaatgttagcagtctctagggtggtactattatgggtctctagcaccaccctagaaactgctaacatttggtgatagctgtgatctaaatatatcccctaaaattcatgtgttgaaacttaatcacccatgtgataatattaagaggggctttgggggtgattaagtcatgagggcagagctctcatgaatgagactggtgattttataagaggtggaagagagtgccctgggccctttttgcccttctgtccctttcaccatgtgaagacacagcattcatagtgtccgtttcctctagagggcacagcaacagggcatcaccttggaagccttcagcaaacactgaacctgccagctccttggttctggacttcccagcctccagaactgagacataaagttttgctcttataaatgacccagtctgaggtactttgccatagcagcacagactaagacagtgatgttttcttccattgtttttccattctcatttatggattatttttatattgatgagatcatttctgcgtataacattttacatctttcttcatttagtagtataatataaccattttaaatactattaaaattattcataaacttttcttttccttggagacagggtctcactctcaactcccagcctggagtgcagagcctcaatttctggagctcgagtgatcctcctgcctcagcctcctgagtagctgggaccacagatgtgcaccaccatgcccagctaatttttttgtattttttatagaggtgggatttctctgtgttgcccaggctagtctcgaactcctgggctcaagtgatctgcccgtctcggccttccaaagtgctgtgattataggtgtgagccaccgtgcctggcccctttgtaaacattttagtggcttacagtgagccactatataagcatattaatcattctctgctgttagacaatttttactatatgagaaataaccactatagtgaacatcttcgagcatagttcctgtcatcatatttgcatttatttccttaaatgtatgccacatatatcaaaggttctgaatattttgaagacatttaatatatttttttcaagttgctttctataaggcagggcctctgttagcccgtaatcggtctttgttcaggtgacaaacctctaggcagacacacccctggaagtccaagcttcatgatgggttccgggctgtgttgcctctgctcacactttgggcgcctcggtgccattcacaactgcactctgtatggaagaccctatttctattcctccaggagctcacacagagtacatgtttcatagaaccccatacagcttagctattcatgtctgtaaaaaacttgaattcattaagtgaaagtgccatacaggtgttttaccctaccctttttgattatggaggatgaacattcatttatgtgtttcttagctatttgtattttatgaattatctattcatattcattgttatgctcttagtgtttgtcgtatattttgtacattaatttgataatatagaatctgtactgtttgttgttaacattcttcttagtttgtgctcatattatttttctggtaaacacaagattttatttttattgagcacagccaagcctcttccctgatgatttactcccaggattttcagttctcagagttctttctcattcagatacttgaaaaatgttcatgttttcttcttgtgtattatttcatttttacatttatctctttgatttacattaaactggagtatattttgatgaataatacccggtgagaatctttttttctttttacagatagtttttgaggcaccatttattacataatctgtcctttccctactgatttgtgatgtgttctctatcttatattaaattctaatatctggatccttttgtagttcatgagcgtgatgattgggtgtttcacgcatgtgtgtgcaatgtgccacccttgaaccttgtatgacatcggcacgttacccatctgacctcaaaaaaaaagcaaagaaaaattatcatctctgttaaacatattttactgagtttaaaaacaataaagattccattcttaatataggtaaagcactgctcattgatgatatatatttttgtttcactgctaatgtttgtttaaattgacttctttttaatgtgttaactttaatgctaacatttctcttttacactttgaatcaaagtaaattgggtactttgacaaacagatttttttgtttcatagagaccacccccatgtacaaataaattgtaggcattgtacataaaaggcacttgcatttacttttaaagaagttaactttttctgtttatgttttttagggtgtattatctcatatactttcagcactcagatttgataaagaagttgctcttttcactcaaggtcttgggtatgcacctatagattactatcctggtttgcttaaaaatgtgagtatttaaaatttatcacttttgaaatgtttaatgctgaatgtgccatcagcaaaaagagtaaatggaaatatttcagtcctccagaagagatgtttaacttttctttgtttatctcttcttaccttgggcagacttatggccatgtacggaagaaatgtgagatgggaagttatgagaaagaaggaaaccaggaagggttttcctaaaccaaccaatcagcctctctttctagggacacatctcacttattcactcagagatgtttgggagaagagctgttcttagctattataaacacagtcttgtactgttgaaagaatcttgtatttcaaataacctgattggaattttctgttaaagcaaaacagaaaattcagtacatagttttaaatatttacctcttaatattaaagcattgttttcttctggcttaaattatagccaaatgtgagaaattttaacttacaaacttgatgtaactcttctaaaaaatgttatgagattttttaatgtttgttaaccattccggtgttttggaagctttgtacaataacaacttttttttttttttcaaatgaactgaattttaaatgaagaagtaaactaacttttctttaaatggatttggttttaattcttaggaaattaatgacctgtctattgttcattgcttaaataggaatgcagaattatagacattaaacataaaatcccaattattagtaaatgtgacatggcactgcttccttttcactctgacagagtgaaacatgagaagatgggggttgggggaatctcaacggaaatatcactcacaccaagaaaaatagaactgatgtaatcctgtttgcagcgtgagttaacctgcaactgattttgttttacagatggttttatcattagcgtctgaactcagagagaatcatcttaatggatttaacactcaaaggcggtaggtgttaaactaaacatccttcttctcaggtttcaaaatgtatcagtttggttatgagaggaaaattttacaattcataggaaatggatgttcagttatggttgtattttatatagaaagattattttagtggaatacatagcaaattggtgagttttttcaaactcttttaaaaatcactattttctcaactctcacagagcagtaagtaaatcatacaatgtcttttgtgggcccattaggtagaaagccctacatacacagtagggagcataaaagaaagagcagtacttagttttaccctgggattgctcactctgcaagaggagaatgtgcacagatgcaagtgtatgctctcacactagcctgccctggctctgccttcttctgctcccaacacacacacacacacacacacacacacacacacacacacacacacgatatttacaaggcaacatttgatgtgaacatatgccctattttaagaaacatgatattccaaaatctagactaaacaaatcaaagagattcagacaaattaaaaggcaattaatcacattacaaatgtttcttcactctgtaaaagaatctcagttttcattggtgggcatttcatttttgacatatcattaaccaagagaatctgggactgagggacttggtgatttttttttttttttgtaaagctattgctaattcaagctctatcagaaattgtctttgtcctcaacctttaggaatcctttgcacctaacccttaaactatataattattagaggaaaacattggagataatcttcattatgttggatttggcaatgtaagaagaaccataggagacatggagagtgtttagatttatttatttacatgtcaggtaaagacttggatttggttgtgaggtgaatgttgactgatggatcttttgaattatgtaattataaatttattcaaaaagaccttaaaaatcagtcagtgcagtgtgtatgtactccctacaccaaactcccaaaatatgcatcacagttgattttttaaaaagcagctgacaataaacaaaataatttttaaaatctgttaacaaatagaaacaaaggatcagaatgcaaaatatagaaatgacttgcaaaaataaatcataaagaggcaaacactccgttatagaaatgagcaaggaatataagcaggtcattactagaagatgaaaactgaattaataataacattaaaggcgttcttcaggaatgacatcagcaagatggcagaataggaagtcctagaccttattttccagtagagacattgacttaactacagcatacatcccaaaaaattatagtgagaactacagaaccaattaagaagtcacagtactgcaggcaagctcaaagtctagaatagccacattgaaattgattaaacaatctgtttcatgtcaactgtgatagcccttttccaggtctggcagcttggtgagattggtaggaaaaacccagcttgtggcttctcttccttgggagggaaaaagaagagtggaatgtgcatccaacattctcactttttaggaagcagactgaggaactgatttctgtctctactgaccgggagcactgatgaggaaatcgcatacagtaatccctccttatctatagggaatatatttcaagacacccagtggatgtctgaaactgtggatagtaccaaacctgattgccaccaatcataacacatttctgtattccactcacaactttaatgtcttttccatcgtaactaagcacttatcatatatgatggctgtaatttttgccatgtgagatgcaacgacaaaactaacagaaatttttttccttctttacaatttcacagatagatgatttgtttttactatagatctcagcaacctcagcatatgatttttttctttccttattaagttgaaaactttcaccttttcacttaaagaaagcactttacaacttctctgtggcatatccaaattgccagccccagtgctcttggactttgaggtcattattaagtattaataaaataagagttacttgaacacaagcacagtgatactgtgacagttgatctgacaaccagtatggctactaagtgactaacgagcaggtagtgtatatattatggataccctgggtaaagggatgattcatgttccagatgggacagagtgggacagcatgagatttcatcatgctactcagaacagtacacaatttaggccaggtgcggtggcacatgcctttaatcccagcactttgggaggctgaagtaggtagatcacccgatttcaggagttcaagacgagcctggccaacatgtcaaaaccgcatctctactaaaagtacaaattagctgggcgtggtggcttatgcctgtagtcccagctactcgggaggctgaggcaggagaatcacatgaacctgggaggtggaggttgcagtgagctgatattgcatcactgcactccagcctgggcaacagagcaaggtgccatctcgaacaaaacagtgcacaatttaaaacctttgaattatttctggaattttttcatttaatatttttggaccacgggtgaccatggctagctcaaactacaaaaagtaaaactgcagataaaggaagactacttttgatgccttggggccatggagaacaaaagaaagcttagtggtttgtggtagcaccagagaattgacagtgctgccgatggaggctggcatagctcaacagaattgggaggaagcacttagctcatgacctgttctttgggaggggaagagaagcctctggcttctcaggggcctactagagggactggtatctgtcttgcctgactcacagcactgacagagaaatggcgtagtttggaacaagagagctcagcagcttgttgcagcactggagaatctgcaataccacaaacggacactagaggggaggggaagattaggagctcttgaaaaaccagtaaagccctctaatttggaaatcacacgcataagcccagagaagatatatccctggaaaaggtttgagggacctccagaatgtctagccgggtccactggtgaaagccttcctttgtaccatgttagtcgataaagactgagagaagtagatgtttctttaaatgtacaaaatacaacaaaaataacaagacacaaagtaaaccagggaaacgtggcataatcaagggatgaaaataaatctacagaaacagaccctaaagaagcagagatctatgcattacctgactaagtatttgaaataattgccttaagggatctcaaggcactacaagagaacacagataaacaactaaatgaaatcaggaaaacaatatgtgagcaaaatgagaatatcaacaaagagatggaaactagaaaagaaccaaacagatattctggagctaaagaaccacaataagtgaattgaaaaacttactagaggggttcagcagtagacttgatcaaacagaagaaagggtcagaaaacttaaacacaaatcatttgaaattattaagtcagagaaacaaaaagaaaaaagaatgaaggaaagtcaagaaagcctaagacacttgtggaacaacatcaaatggaacaatacacacattttgtgagtcctagaataagagagaaaggggcagagaacttatttgaagaaataatggtgaaaacttcccaaatattaggaaggaattggatatcctaatttcagaagctcagcagactccaaagaatgaacccaaagaggcctacaacaacatacacaaaaatcggattgtcagaagttaaagacataatcttgaaagcagcaagaaaaaagtgacttgtcatgtacaaggaaggttccagaagattatcagtggatttctcagcagaaatattacaggccagaaaggagtgggatgatacattcaaagagccagggaggaaacaaaacaaaacaaaaaacccttccaatcaagaatactgcatctgggctaaatcatccttcaaaaaatgaagaaaaaaagacattcccagataaacaaaagctgaaggagttcatcaccattagacctgccttacaagaattgctaaagggagtccttcaagttgaaatgaaagaatattagcaacatgaaagcatgcaaaaatataaagccttctggtaaatgtaaatatacagacaaacacaaaatcttataataccgtgttgtatagtacagttgtccctcagtatccagagaggattggttccaggacttcccacacataccaaaatctatagatgctccagtcccatagtaaactgtatggaacttacagatacaaacgttcaatctttgggttctacatcctgcaaatactatatttttgatccatgatttagttgaatccatggatacagaacccatagatatagagggctgagtgtacataaatcactttttaattctggtatagaacttaaaagataaaagtgtaaaaataactattaaactgtgttgatagatacaaaatagaaaaggatgtaatttgtgatattgataacataaactggggagggaaatgtaaatgagtagagttttagtatgtgattgaagttatctcgttaggttgttagaactctaagatgtttaatgtaatgcccatggtaacaacaagaaaatacctgtaggagatgtacaatggaaaatgagaaggaaagcatgtcactatgaaaaaaatcaatgaaacccaaaggaagggaataagagaaaatcgtgaacagaataactactaggtatatggaaaacaacaaaatggcaatagtaagtccttctctatcagtaattactttaggtgaacatgaattaaacaccccattcaaaagatgtggaatagcaaaatagatcagaaaacaagatccaactatattctagctacaagagactcacttgagatacataggctgaaaatgaaaagatggaaaaatggcaaccaaaatagagcaggcatagccatacttatatcaaactatcaaaagagacaaagaaaaagattatataataataagagtgtcaattcagggagatacaacaattacaataatatatgcacttaacacagcatccaaatatatgaagcagataccaatagaattgaagggagaaagagacagtaacacaataataatagatttcaccaccccacttttaataacatattgattaaccagactgaagaccaataaaaaaatagaacttgaataatgctgtggaccaattggacctaataggcatatagagaacattctacccaataacagcagaatatacactcttctcaagcacatatagaacattctgtaggaaagaccacatgttaggccacagaacaagtcttaacaaatttaagaagactgaaatcatagtaactattttttctgaccacaagggaatagaaatcagtaacaaaaagaaaattggaaaattcacaaatatgtggaaattaacccactcttaaacaaccagtgagtcaaagaacaaattacaagaaacacagacaataacttgagacaaatgaaaatgaaaacccaacatatcacaacctatgggatgcagcaaaagcagttctaagcaggaagtttatagtggtaaatgcctacattaaaaaagaagaaagtgtacatgcttttgaaggaagaaaaaaaaagaaaataagaaggatctcaaatcagaaacctaactttacacctcaagcaactagaaaaagaacaaactaaacctaaagttaaaagggagagactaataaagattagaacagaaataaataaaatagagaatagaagaaaaaactaagagttgggtttttgtaaagatcagcaaaattgacaattccttagactaagaaaaaaaaagagaagacttaatagcaaaaatcaggaataaagaatagaaattaaaactgatgccacaaaaattaaaaagattgagactactatgaacaattatataccaacaaattgaataacctagaataaataaatgtctaaaaatatacagcctacacgactgaataatgaagaaataaaaacatctgaacagacctacaactagtaaagagattgaattggttattcagaaccttccaacaaagaaaaaaaccaggaccagatggcttcactggagaattctatcagacatttaaagaagaattaacaccagtctttcttaaagtcttccaaaatattgaagaagaggggacatttccaaactcattttgtgagcaagcattaccctgacacgaaaatcaggcaatgaaactacatgaaaacagattaatatccttcgtgaatcatgatggaaggattctcagcaaaaagggaattcaacaatacgttaaaaagatatgtataaacaccatgactgaatgaaaattattccttgaatacaaggatggctcaacatacaaaaatcactatattgcaccacattaataaaatgatgaacaaaaaccacatggatcatcttaatgcagaaatggcatatgacaaaactcaatactcacttatggtaaaaccttaaacaaattaggaatagaaggaaatgacctcaatgtagtaaagtagtaaaggccatatttgaaaaatccatagctaacatcatactcagtggtgaaaaagggaatgttttcccgctgagatcaggaacaaggcaagaatatcttcatcctctcttaccacttgtatttaatatagtatcagaagtccttgtcagaggaattgggcaagaaaaagaaataaaggtcaacagatgctccaaattctttccatccaaattggaaaggaaggaataaaattgtctctgttcacagatgacatgattttatatgttaataatcctaaaagatttcacacaaaaaaattgttagaactaataaactaattcaacaaagttgcagtatacaaaatcaacacacaaaaccagttgcattgctatacattaataagaacaacccaaaaaggaagtttaaaaacaatcctgcttacaatagcaccaaaaagaataaaatatttaggaataagcaactaaggaggtgaaagatttgcacagtgaaagctatacattgctaaaagaaattaaataagacataaataaataaaaagatatcccatgttcatagatgggtatggtttttttggggtttgtttgtttgtttatttttgttttgagatggagtttcgctcttgttgcccaggctggcatgcgatggcacaatctcggctcactttaacctcctcctcctggattcaagcgattctcctgcctcagcctcccgagtagctgggattacaggtgcacgccaccatgcccagatgattttgtatttttagtagagatgggctttctccgtgttggtcatgctggtctcgaactcctgacctcaggtgatccacttgccttggcctcccaaagttctgggattacaggtgtaagccactgcacccagcctatgcttagtattttaaatgcccgtactacccaaagcaatcttcaggttccagtgttatttctatcaaaatgtcagtggcgtttggtttttcttttattttttacagaaatagaaaaagaatcctttaatgtatatagaatctcaaagtaccccaagtaaccaaaacaattttgagaaagaaaaacaaggtggaagcctcatacttccttttttcaaagcatattacaaagccacagtaatcaaaacagtgtggtactggcataaaggcagacatattgaccattaaaacagaatagagagcccagaagtaaggcttcacatggaagatcaaatggtctttgacaagggtatcctgtctataagattgggaaaagattgtctcttcaataattggtgttgggaaaactggatatacacattgagaaaacaaatttgaacccttacctttcattatatataaaaactaactcaaaatagatgaaagacctaaacgtaagacctgaaactgtaggagaaaagtgtcatggcattggacttcgcaatgatcttggatatgacaccaaaagcacaggcaagaaaagcaagaatagacaaataggactgcatgaaatttttaagtgtctgtgcaacaaaggaagcaatcaacagattaaaaagcagcctatgtaatgggagaaaatattttcaaaccttaaatctggataagtgattaatatccagaatatacagagaattcctgcaactcaacaacagcaaaataatccagtttaaaaataggtcaaagacttgaatagacatttctccaaagaatatatacaaatgaccaacaagcatatgaaaagatgcccaacatcaccagttatcagggacatgataatcagaaccataataagataccagttcacacctattagaatggccactatcaaaagaagaaagagaaaatgacaaatattgatgaggatgtggagtacttggaacccttgtacactgttgctaggaatgttaaactagtgcagtcactatggaaaacagtatggagtttccttaaaaaattaaaaatagaattaccaaatgatccagcaatcccatatttgtgtatatttccaaataattgggaacaaaatctctaagagatatttgcacacccatgttcattgagcattatttacaagagccaagaggtggaagtaacctatgtgtccatcagcggacgaatgaataaagaaaatatggtatatatacacattggaagattattccaccttagaaaagaaggaagtcctgtcatatgctacagtgtggatgaaacttaaggacattatgcaaagtgaagtaaactagtgacagaaggcaaatactgcatgattacttacacttatgtgtggtatctaaattagtcaaacttgtagaaacagaagctaagggcaggtgcagtggctcacacctgtaatcccagcacattgggaggccaaggcaggcggatcaccggaggtcaggagtttgagaccagcctggccaacacggcgaaactccatctctactaaaaatacaaaaattagatgggtgtggtggcgggtgcctgtaatcctggctacccaggaggctgaggcaggagaatcgcttgaacctgggaagcggaggttgcagtgagctgagatcgtgccattgcactccagcctgggtgacagagcaagattatgtctcaaaaaaaaaaaaaaaagaaaagaaaagaagcagaaagtagaatagtggttaccttgggatgggaggaagagggaaatgggagttgttgttcaatgggtatagagttttggttttgcaagatatgaaagttttagagatctgttgcatataaggacatatagttaacactactgtactgtatagttaaaaatggttaaaatggtaaattgtatgttaatgtgtttttcaccacaatttaaaactggtctatgagcttttctgtgcattttcaggaaagtgtaaactaacaacatcagttagacatccattaggttatggtgagctttaggaggttgctgatgggaacataaataggcacaaccactttgcagaacaatttggtcttcctggaatttgggattccttgttagtctctcgatgagtgctctgtttactgtagcctccaataattatgggaagatcaagaggtagtgttgattgaggttgccagtaaattgtattctgggccttagaggactcccatatttcctggaggttgatagccattttgggctggcttctccttccaggcctccttcctccttcctccttcctgttggagtcaggacatttctgttatctcttgcctaaagacagtggataagaagaaagagtgtataatgtataaggccttggcagctggctgtcaggttgccccctgttccttgaattcatccccaaagtaactcttatcttttatagtagtcctctcttggcaagcttttagggctgtggtattttccttcaaaaagatcccacctacctaccatcaagcttttctcagaattcatgggtcaccaaaagcccccattttacagtattatatatttaattgtaaaaactcttccatcattgacatgattgtatatttagaaaaccccattgtctcagcccaaaatctctttaagctgataagcaacttcagcaaagtctcaggatacaaaatcagtgtgcaaaaatcacaagcattcctatacaccaataacagacaaacagagagccaaatcatgagtgaactcccactcacaattgctacaaagagaataaaatacctaggaatacaacttacaaaggatgtgaaggacctcttcaaggagaactacaaaccactgctcaaggaaataaaagaagacacaaacaaacggaagaacattccatgctcatggataggaagaatcaatatcatcaaaatggccatactgcccaaggtaatttatagattcaatgccatccccatcaagctaccaatgactttcttcacagaattggaaaaaactactttgaagttcatgtggaaccaaaaaagagcccacattgccaagacaatcctaagcaaaaagaacaaagctggaggcatcatgctacctgacttcaaactgtactacaagtctgtagtaaccaaaacagcatggtactggtaccaaaacagagatatagaccaatggaacagaacagaggcctcagaaataacaccacacatctacagccatccaatctttgacaaacctgacaaaagcaagaaatggggaaaggattccctatttaataaatggtgctgggaaaactggctagccatatgtagaaagctgaaactggatcccttccttacaccttatataaaaattaattcaagatggattaaagacttaaatgttagacctaaaaccataaaaatcctagaagaaaatctaggcaataccattcaggacctagtcatggacaaggacttcatgactaaaacaccaaaagcaatggcagcaaaagccaaaatagacaaatgggatctaattaaactaaagagcttctgcacagcaaaagaaactaccatcagagtgaacaggcaacctacagaatgggagaaaatttttgcaatctagccatctgacaaagggctaatatccagaatctacaaagaacttaaacaaatttacaagaagaaaacaaacaaccccatcaaaaattgggcaaaaaatatgaacagacactctcaagacatttatgcagccaacagacacatggaaaaatgctcatcatcactggtcatgagagaaatgcaaatcaaaaccacaatgagataccatctcacaccagttagaatggcgatcattaaaaagtcaggaaacaacaggtgctggagaggatgtggagaaataggaatgcttttgcactgttgatgggagtgtaaactagttcaaccattgtggaagacagtgtggcgattcctcaagcatctagaactagaaataccatttgatccagctatcccattactgggtatatacccaaaggattataaatcatgcttctataaagatacatgcacacgtatgtttattgcggcactattcacaatagcaaagacttggaatgaacctaaatgtccatcaatgatagactggattaagaaaatgtggcacaaatacaccatggaatgctatgcagccataaaaaaggatgagttcatgtcctttgcatggacatggatgtagctggaaaccatcattctgagcaaactctcacaaggacagaaaaccaaacaccacatgttctcactcacaggtaggaattgaacaatgagaacacttggacacagggtggggaacatcacaccctggggcttgttgtggagtggggggcaaggggagggatagcattaggagaaatacccaatgtaaatgatgaggtaatgggtgcagcaaaccaacatggcacgtgtatacctatgtaacaaacctgcacgttgtgcatgtgtaccctagaacttgaagtataattaaaaaaaaaaaggtcaaaaaaaattcttccatcatttctagcagttgggagtatagcatgaatgctaggacatccgtgtccttagttcattgcttgatgcagtctcttaggttacattttcatcttattttctcttgactagattaagagagtcaccattcttcataggtcttgcctttgagtcctcaggatgtgtagcagttctacaccagagctactcaaagtgtggccctaccaatcagcagcatcaacatccctcgggcagagaccaagaaatatgactttttaaaaacatctgtccagacatactctctggaagttcaagaaatgctgctctacactacttctttagaagcagttcccataactgcatatcaatccctggtaacaatctgaatactttatggtgacatgatagaattttatttacggtttttatttttgttgatgaattcctataaattgttaatatttttgctgtattcttgataatagtaaattctcataaagataattttttgccaagctacccatagtgatctattatgtgtgaacagtttgtcttttctcctcaaatattcaccttttctaaattgttcttcctgttctctaccacttcttaagtggcagatatcctttcaacatttaccttccatagtgctttatcatcgttctcttaccaccaagatggttttagatctaaaattaattaatatgctttttgagtctatcatctaagttgttaacaaaaagacacatttagcatgagttgtaaatatcttaaatttttggaatatatgagcttagtgggtgggctggtagaggaagaggtatgtgggggtgtgtgtgaaaggtgtatactttgcacatagcctagcagaatatattgcatagagttagggcgggatggatgtttgtgcaattgaaaggtaggccggagagttgcctgtgtgcatcactcatgtagcgtctcaaataggcaggcaggtctccagcctgactcatcaatcttcctccctaaaagatctctaagcgcaacttttctctcatctgaaaagaggaaatgagaagagtcagagattattactggggactgagtgggtggaaagactgtggttctggggacatttatcaagtattgcagttcatggctgcagattatatcttctgtttaggctggaaatgatccaggataattttcctgaaaaatttaaaaaatctcataaagacaggtagttcttgggtataccaaaatttgggcaggccaactgataaccttcccaagaacttcaaggtgcacgcagccttcatggctcctcttttggtctgaagtttgtcagagtgtggagatccaagttcaagtggagagttacgcaacactttccagattgaattacactaagcattaggtcttgactggttgccagagcagcacttccaaataatttctgcacaagaattcaactgcagaaggctagacggtaaccatgtactgctgggaacatcctttctgtgtggttgtattgtagcttccaaaccatctgccccaaaccatagagctacaggataagctgacgatgctcagaatgttgctccttctagatggtttgtagcaaagaataggatagaatttaaacattctgtcactgaattgttgactttacttggtggcaagtgaaactctatttaaagccctatgacaacaccatttatcaggcctctaaaaataatgcaaaaagaaagtaagctaattttcccactttttttgttcctctggcgatctgtgcatctgaaattatgagatcaatttctatattttctgagactttttgaatctttggaaatgaactttagacactgaagtgctaaaaaattagaaaaaataaatgcatagatgccttctagaaggaaaaaaaaacacaggaaaacagcatagcattgtttatatggtgcttaagtttgggagctcttggctgcttcgacatttgaagtcatacttgtgaaaggagaggaattagaaacttagattcataggtggatgggactctcctgactttaagcatatactggaaagtagtttgcctgttatgctgtgttctgatttaattgtttcaatttgtaaatcttaaaagtggacagagaacttcagatatgtagtagaaagttatgtggtattatgatacctattttaattgttattattaatgacagcaaaaattatgatggctgcagcgtggttgacagctgttttgcaaaggttatcatggtgtcagagatgttacctgatttcattaaaccggcttctacttgagatagaagaatacacttggcagaatttataattcactggagaactgtggacttgaaaagttttgttctcacacaagcttttaagaatccaagttaaaattttatgaatggtgatcacaaaagcttctaaaagggctcaaaaagcatgttacgcatcaaattgctttttaaattcaatcttctgataggtataaatgaactcagtccaagagattgaattatcttaaaaactatatataagggctcaacacattcagaaaagtacctggacaaatttatctggttgaattataaaattctttaaagaaaagattctaaacatcattcagtagagcaaattaggaatgtatcggatgtgttggtttacagggagcactctgctagcacaggcatctcatattcttagtaaattcagttaagaattttactgattgtatcatagctttgctttgactaggaatatcctgaactgctaactaaattaattccaattttatccttgctactcctgccagctgggatgccagcatggacatccttcagtggacttcgctctgtgccagggaatttgttcatattacttttgaaaaacaagcattcttaacaacaacaacaacaccaaaaaccaattataaactagagaataaacctcttccaaagtggcacaatctggcacaaaggcaaatttttaatctataaaagttgtttcagccttggcacagtggctcactcctgtaatcccagcaatttgggaggccagggtgggaggattgcttgaacccaggagtttgagaccagcctgggcaacatggagaaaccccatatctacaaaaaaaaaaaaaaacccaaaaaaagccagatgtggtggcaagcacctgtaatcccagctactagggaggctgaggtgggagcatcgcttgagcctggggaggttgaggttgcagtgagccaagactgcaccactgcactctagcctgggtgacagagcaagaccctgtctcaaaaagaaagaaagagaaaagaagattgtttcagctgataccatccagcagagtcttttaattgtggtccaggagactttaaaaacctctgtgaactgcttgtcttctgtccaagggtgagaaaatgaaaagcacaaataattctatagaaataccctgaaaagagaccagtagaatcaaataatgggaagagtgcaaaaaaagatgtaaataaaggggaaaaaatactccagagggaaataaatactaagcaatttaagactgattaaggatgattagtttttaatgagctacttttgctgttttggaaataagaacctgaggcaggaagtaactcctttattacgaatattttctttttcctccctccctccctccctccctccctcccttcctcccttccttcctcccctcccctcccctcccctcctctccccttccgtccccttccttcccctcccctttcctcccctcccctcccctcccctcccctctctcttttctctcgctctctctttcctttctttttttgacagggtctcactttgttgcccaggccagagtgcagtggcatgatctcagctcaccccaacctccacctcctggactcaagccatcctcccacctcagcctcccgagtggctgggactacaggcgtgtgccaccacacccagctaatttttgtatttttttgtagaggcagggtttcaccatgttgcccaggcttatctcaaactcctgggctgaagcagtccacccaccttaacctcccaaagttctgggattgcagacataagctaccacacctagcatgaatattttcattttcagtattttactagttaacattgtattttagttttttaaaagttttattataaaacacttatgtcatggaaaaactgtgtgcctgttgcccaggttttatagtgctaacattttatttatatttgatatttttaagaaaaagtttcaattagagctgaagcatccttctcctattccatttctttattctccccgctggagcaagcacgcccaagaagtggggtgtagattcttcctgccatgttttaacacttttacttcacatttcgctgtgctttaaaactttacataaggatggtgtattgtggatatctttatgcaacttgctttcttcattcattcaacttttgagatttatgtatgcagataatgtaggtacagtttattcatttaaactgccatatagcattccattctgtaaataaataatcatttattcatttctgtacaaattcacagcaagattgaatctaccttttacaaacagtcctgtttgtctccctaacctgtaagaagaaatggtagcacgttgctaccagttgttctccaaagtgtttgtgcttatttatttatgttcctatcagaaacatcctggagttctcttttctctgtaatctgatggatttcccactacaatttttttttttttttttttttttttgagacggagtcttgctctgtcaccctggctggaatgcagtggcgtgatgtcagctcactgcaatctccacctcctggattcaagcaattctcctgtctcagcctcctgagtagctgggactacaggtgcccaccaccatgcctggctaatttttgtatttttagtagagatggggtttcaccatattgatcaggctggtctcgtactcctgacctcaggtgatctgccctcctcggcctcccaaagtgctgggattacaggcatgagccaccacacccagccctcccactacaaatttgatgttatagtttgtattgaacaacaaacaacacattgaagtactaaagaattaattagggttgaaagtaatttctggacatcagaaaatggggataggaatgccctttcaaaagctactattttgattaactttgaataactatttgaccatttcaagtagttacatcaaagaaataaacagacaaccaacagagtgggagaaaatattgcaaactatgcatctgacaaaggactagtattcagaatctacaaggaactcaaatcaagaaaaaagcaatcccatcaaacagtgggcaaaggatatgatagatatttctcaaaagaagatgtacaaatggccaagcatatgaaaaaatgctcaacatcacgaatcatcagggaaatgcaaattaaaaccacaatgagataccaccttactcctgcaagaatggccttttagatgttggcatggatgtggggaaaagagaacacttatacctgctggtgggaatataaattagtgcaacctctatggaaaacagtatggagattcctcaaaaagctaaaagtagatctatttgatccagcaattacactactggctatctacccaaaggaaaagatgtctttatataaaaaaaaaaccacttgcatatgtatttttatagcatcacagttaacaattgcaaagatgtggaaccaacataagtgcccatccaccaatcagtggataaagaaaatatggtatatatacactactcagccattaaaaggaacaaaataatatttgcagcaacttgaatggagctggaggccattattttaagtgaagtaacacaggagtggaaaatcacaaactgttatgttctcacttattagtgggagctaagctatgagtacacagagacatacaacaagcttgtcgaacctgtggcccatgggctacatgcagcccaggacagctttgaatgctgcccaacacaaatctgtaaacttgcttaaaacatagtttttttgcgattttttttaagctcatcaactatcgttggtattagtgtatttagtgtgtaacccaagacgattcttctttttccaaaaagaaggaagccaaaaagattggacatcgctggcatacagagtgacataatggacttcagagactcagaagggggaggagagtgggatggggggtagtgaaaaaaactacacattaggtgcagtctactcgggtgatggatgcattaaaatctcagaatttaccactatacaattcatccatgtaacaaaaaactacttttacccacaagctattaaaataaaaattttaaagtaaatagtctaaacaaaaaatatagttgcatttattaatttcataaaaatgaaaactaaatttttacaaaaagaatatgcaggcccctacagtgatctacagaagcctttccgccatcctccccggttcactgggtgtggccacgttggtccccttgctattttcagatgctgagggcctttgcttttgcttttcatctgtctgcaatgttttcttcccagatatatacgtgcttgttcatgtacttccttcagagctctgctcacatatcaccttcttggtaaatttctgtcacttctgagtattctttacttttcagcatgacactcagtatcatctggcattatattgttcctctccctgatgagacattgtcatctttgcatctgtgtcatgtacacctcaaacagagccttgactacagtaggggatcaataaataggtattaaatgaacaaataggacaaagatacacaaatatataaacaaattctctgaagaggaaatacaagtgggtaacaattactgtctcacaagttatcaggaaaatgcaaattaaggcaaagaaatagcaatttttgtccgttaaatttgcaagaaatagaaacaaataatgatataattggaaagggtggaaaagtaaattggtgtggtcttttgcaaggcagtttttttttgttttgttttttgttttttgtttttttttttttgagacaggtctcgctcttgtctcccaggctggagtgcagtggtatgaacacagctcactgcagccttgacctcttgggctcaagcaaccctcccacctccgcccccccgagtagctgcaacgcaggcgtaagccaccacacctggctaatttttgtattttttgtagagttggggtttctccatgttacctgtgctggtcttaaacttctgggatcaagcgatctgcctgcctcagcctttcaaagtgctgggtctccatgtgtgagccaccacccctggccttggaaggcaattcagtatgcaaatactcacacatgggcacagacaggcatgggcaagggtagcaccacagccctgtctgaatagtgaaaaaccagaaacagcctcagtgcctactgatagtggcattgttaaattacagaacatgtttgttttaataataggcagcaagtttttaagaatgaggaacagctacatgctctatactgtggtttcatttgtgtttcacaaaacacaagactaaatttctatatttacaattacatatgaaaatacctagaatagcctccacccagaactttcattttatttatcattcactggagacggatttgttgagcacgtgctgtgtgtgaggagttatccctaggtgctaggaatagagcggtgggcaaagtaggagaagctgcctgccattgtagagcttctgccctcagaggaggaagcgaaccatgagtactataagggaatactgtgtaggtcaggtggtgaaaggtaccaggaagagaagtaaagcacgggtaagagggcacttgaagctcgagtgtccagtggcgctttctgcagtcccaggcacatcctgtaaatgtgcactgttcggtactgtagccgccagccacctatagctgttgagcacttgaactgtgactagtgcagttgaggagctggatttttaattttatttcattttaattcatttgcatttaaattgccacacatggtagacagtatagtgacatgggatgatcagagaagacctcacttaacaaagggacatttgagctgcaaccagggagctaatcatgtatttcaggcagagtgaacagcaggactttatttggggcagtcagaggcagaaaagacaaaggtaagagtggaaggagattaagtcagtgaaacagacggggacccaccatggaaggacttgctggctagtgaaagacattgcttattctctacatgaggtgagaagccattgcaaagctttgagcagacaagtgttgtgatcggaatttttaaaggggtgctggaactgttctgatgttaaactataggagtgagtgcagaaacaagaaatccagaggctactctgtcacccaggctagaggtggtggtgagttactctccacttaggaggacagtgatggaggtgttcagaagaggtcagatgtgttgctagtattcactgatggatcagatgaggggcctgagagaaagggaggaatcaggatttgggcctgagcaaacaagatagcactggggaaagggaacactgggaagggaattcaggagttgtgttttggacatattaagtgcctgtgaatataaagaacaaagtcctgaccatgaatgacactgaaacagcaatggtagctaaaagatttcttcctaaagaattggataaaagagaagtgttcatcgatggtgttagagtcattctctttatttagaggcaaaacaggtgatctgtctttgacctttttagcatgaaggtttttatatgtccttaattatgcatggctcttagatttgagtgattatttcttatttcttccatagaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgtaagtggcaaatgtttcctgtcatcctgcgtcgtttttccttttcttagaaggctgtggtgtgttggaaagactgtacgacagcagtgtccaaacgtttttgtctcagtaccctttatactcttaaaaattactgagtatcccggccaggtgtggtggctcacacctgtaatcccagcactttgggaggccaaggcgggtggatcacctgaggtcaggagtttgagaccagcctggccaacatggtgaaaccctgtctctactaaaaatgcaaaaattagtcaagcatggtggtgtgtgcctctaatcccagctactaggggggctgagtcaggaggatcgcttccacctgggaggcggagattgcagtgagccgagattgtgccactgcactccagcctgggcaacagagcgagactccatctcaaaaaaaaaaaaaattactgaggatcccaaaacattttatttttttatttttaacttttattttaggtttgggggtacatgtgaaggtttgttacataggtaaacacatgtcatagggttttgttgtacatattatttcatcacccaggtattaagctcagtccccagtagttaccttttctgctcctctccctcctaccgttgctcaggtaggccccagcgactattgtttccttctttgtgttcatacattcccaagagttttaaaaatctgttaaacccttattaatatttatcatatttgaaactaaatttttaaaaatgtgtttgttacttaaaaaataaaaataattttattacacgttaacacaaatagcttatttttatgaaaagcaatgctcttttccaaggcaaaaaaaaaaatgtttgacaaaagcagcattgtttttacatttttgcaagtctcattttctaccctaagactgctgaattctcatatctgcttctggtgggacgtgttgttttggttgaagtgtatgaagaaaatccagccccacatagatagtaattgggaaaggcgggaatattctagtagccattgcagatcattgtggataattctgctttgatagctcaccaaaatttgaaaatggtcattttttaaagggtagttgcaatgtggaatctgaaattatgtcagttaactttccatactctgttacattagaaacccattggtctgtcttgcactttcaatggatcttttttgccaacacacataattttgtagcattatgcatggttcatttggaaaatcttcattcattgagttatgtatatcttccaaacattgacatatttcatatgcagtatcaaaacctatagtcattactgccaccatggagctcatcagaaatgactttaagtattgggaagctgtcaagcttatgttggtggacatagattttccaagattctaatttctgcttaaaagctaaaatttatcatgggctacaaacactgtcagtcattttccttaggggactgagtcactttgctaattattgagaaagtatgtgcctaatcctaaaatgtgactgaccactgcctgtctgctagtcattctttcaggtcaatttccatgacaaaaagtggtcaagtgagcccactgctgaaagagttgtgcaggtgtacaagtggagtgcttttctccaggcaaccgtctttttttgttatgaagcagaagtgctttatgcacactttccttttcaccgtacagaattcttttttaaaagtatccttgagggcaacagtttaataaagtcagtatgttaaactgcttcatcagacattcatatgtgaaaatgcagtgtttcgactgtgtgtgtgtggtggtgaagagtagcgtgagggctgtctcggctctgattcccactgagacacagctgtgttacccactgttgcttttgcgctatcagtgcaaatgtcaacacggttattccaggaaaaaccaggagattcaaaatagttattcagtactttaagtatttccctaccacttgggtgtgtggccaactttcatataaaagagcttctgtgcttaagttggtgctgataccagacaagtacaagcaatacagtaagtccagagattctattgtaaggcagaagtacagttctcttggtgacatattaatttatcacatctgcatttaaattttttttcttcagactctgaatgattggtctcaaactgatgtggcagttaacttgcaccataacagtattcaaaatattgttgcataagacacaataaggtaaatcattaacatctgtaaaggcaagggaaaaataactttcctcacattttttgtctttatttacagtttagcccactttctctgtagcagatgtctccatctcatgagtcagagaattctctgatgtgtcagtttcatcttttcttttcttttcttttttgagacagagtttcactcttgttgcccaggctggagtacagtggtgcaatctcggctcaccgcaacctctgccttccgggttcaagtgattctcctgcctcagcctcccgagtagctgggattacaggcatgcaccatcacgcccagctaattttgtgtttttagtagagacagggttttccatgttggtcaggctggtctcgaaatcccgacctcaggtgatccacccacctcggcctcccaaagtgctgggattacaggcgtgagccactgcgccagccagtttcatcttttcttgatgaaacatctgtaggatgagaaattgaatcttttaatcctcatttttaaagccagtgatccattcttaaatgcaagaaaatacatcataaataaatgttacttttcaaatagaatattgtaaaattccaaaataataatctaaaatatatattaaaatatataagtaaaatatacactgtatatatacatacaaatatatatctaataaaattatctaaaataacttagataaaatttaaaaattagaaaagttttcaaaattaaaaaatatatattactacaaaacccaacaaagtgtacttatttcttcttatgtttccacgtaggcccaagaaaaatataagaattttttaaataatgattttttcttttaacgcatctcagttcttccctccctctctggaaacagttctttgaaccccactttgaaaattgttgcatggcctctgactactgctgtagtcatgactccaagttacgagtggctctgtctgcagtgtttgaaaacactgtgaatccactgtgtggtataatttgcagagccctctccgtctcagataatgagatccaaagcattcacatttccgaattcaaggtatacatgcaatgtgattttaaaatgatacttactgcttataaacttgacattttgttaagaatactgtggtttttaaatcattttattaatactatttacgttttcaatttttttttttttttttttttttttttgagatggggtctcactctgtcacataggctggagtgcagtggtgcagtcttggctcactgtagtctcaaactcccaggctcaggcgatcctcccaccttagcctcctgagtagctgggaccacaggtgtgtgctaccatgcctggctaattttttgtattttcggtagagacggcatttcaccatgttgcctaggctggtcttgaactcctgggctcaaggagtctgcctgtcttggcctcccaaaatgttgggattataggcatgagccactgtgacaggcccaattctttatttaaatactttcagtgagaaattggagaattgttacatatgtagacccttccttgctatacaatgcattttaaaaaaacaaaactacaataccattattacatcttaaaattgacattagttccttatcatcatcacatatctagtcaggaattaaattatcctgattgtcttagaatttttcttccagttggtttgttagaatcagagttcaaataaaaaaaaataaagaatcagagttcagatctacacattgcctttggtttatggttcttttaagtctctttcaatccctctttgttttttgttttgaaattatttgttgaaataatacggttgttttccccgttctccggtggtaaagcatgtccgccctcttgagtgtgataaagggtgcgtgcctctggagcacagtcctgtgggcttaggtggttcccttgtcacattctcagttctcacatagtcaggcctgttttgttaccttctgttctggttctctggtctcttgcatgtgcgtgcggcagtatcactgctttagtgctggcatcaactgtgttcaatacaaaataaggatcattccctttgatttctcttctttactagggttgttattagtttgttttgctatcattgcttgtcttatattccacataaactttgaaaccaatttttctagttgcagggaagacacccagtgttgttgggggaagactcctgtaagtatatagattatcgagagagctggcgttttcatgatgttaaggctgtctgtccgcctgttcaagaacacatacgttttaccatttgttaagcttttgtgatctgaagggagtgttgtatatatttttcacacattggatttacacatttcttgttcctaatgttttgttgtatttgtgttttcaatgttttcactgtcataaatggatcttctcctccatcttcaaatagattttcattgtgttgtttgttgcgtttggaaaacaaaacaggctcaaaaccaccgttgttcttacagttcagagtatttccattttttaaatctataactcttaaaaattaggatacatattttaatttcagtttatatgaaaggttataatccaggattttgtgaaagtgagatttaaaaagagaaatagaagattaagtcacttgattcgaaaaatggtcaaaatgcaggtttcatggctaaaaaaataaaatggccttttttctacctactcttaaaccttctgtcaaaattcacccagtaagtggagtgagctttctgaggagtccgagcgttatgtttggtccttatgtgagatactgagtaaagggcgttgtgaacgtgcggcgcggcgctcgattctttccttacagtgcccaacacccgcaatggagcacacgcttcacggccccaccactgatcacaccaactggcatttttactctccacggcgatttttcaaaatacttacaaagaatatttaactaaaatgctcttgcctttcactgtggcagctcccttcttgattcatctaggaatatatttcacaggagaatatggtctcagccacccccgtgtctagccttactctttcagcaagagctgaattaaagggaatctggaagtgaatactcctggtcttctgtgaaaccccaaaagctgtttgagaaatcactggccaggcgacgtgcccagagaacagctactcctgctctagcacagtgctcagagggacgctgagggcagcggctccccaagcaggcccacactcccttgcttgtaattttgcttgtgatagcatgttctccctcaacaactcataaaatttatttggtttggaaagttatgtctgctaatccataagggacagactgtccagaagtgctgggtggtcttcagtgtgtccaaatcctgtggcttcagctcagcaagttccccaagcagtggcgtaagagctggagcctctccatggacactttcccgtaggcggaacatcccagccacatgttgacacagcgaggctgatccaatcaatcagtgcaaattaccagccgcgcccagccccccctccccagatgtgctgcgtggtcatttggaaaccacatgctttctttgaccaatgcactctaacccgtgtttagccttccaactatttgcttaccacagtacaccagtggaatttcatctgtttgacaattggctggtgtctttggtcttggcttccaaatgcagtcatatattttcagcagtggtctgcctgtcttttaaacagcagatgcttgcccctctttatggtttagataacctagaggaacttttaaatttcttggcctaaatgtcaacttttcatgtctgtccctggggctgccgtcataggcacctgcaggctaaagacggcataaaaccttcctgggcgggctgctgaggtccttttgtaagtctggagtataagtaatacagcatgacatgtcctctgaggtcatccgaatccactgcttcaaaaatactgagaagcttgaagactggatggagaatttgttctatatgcctgaatgaatgagacactgaacaagtgaaaaaaagaatgaaggcatgacggtgatctcgtgatataataagaaatgtgcatttggtcttcatccaggctcctaaaacccttgaaatttcctgagtgatgaggtgagaagagcatcttttattattcataagtcccttttcaccacacctgagtgtaggctaatgaagtgactcctggtgggcccccagatagcctcgggatgggggctggtagccaaaggaaccaaccacacctgacccccagagttcgacctgatcactactggccagcgatttaatcagtcgtgcttacattgtgagacctccataaaaaacctaaactgtggggttcaaatagcttccagattggtggtcacatccaggtgctgggaaggtgacgtgcctggagagggcctggaagctcagaactttcccccaggcctggccccatgcatctcttccatgtggctgttcctgaattgtatctttcagaataaattggtaatggcaagtaaagtgtcttcctgagttctgtgagccattctagcaaattatcaaacctgaagagaggatcattggaacctctgattttatagctagttggtcagaagaatgagaggcctagacctgtgattggcatctgaagtgggggcagtcttgtgggactgagcccttaacctgtggggtgtgtgctaatgccagatggtgtcagaattgaatcactggacacccagttggtgtctagagagttgggagcattggtttgtgtggaggaagaaaatccacacagtgagtgtgagaagtgctctgtgagtaaaaacagcttctaagtagtgggagtgactgacatacgagtctctgaccactctaacactcgcagctcggggtggctctgagtgttaaatagggtggccatatgatttaaaatctagaccatgccacttctgagagttaaaagagatcccttttataagtatagtgggataacagaaataaacttacaaactaggacaaatacactaagatttaaatgggttgaatgactgtaatattcttagcacagtgcctcgtatccacagtaaataccccgtaaccattagcgtctacagccactccaccctaaatgtgcccagtcttgcctgatctcagaagctgaggggggttgggcctggggattagcgggtgctgtaggctttaaaaaataaaaataaaaagacaggcacagtggcacacacctgtaatcccagctactcaggaggccaaagcaggagaatcacttgaggccaggagttcaagtccagcctgggcaatgtagcaagaccctggctctaaaaaataaaaactgttggtggccgggcacggtggctcacacctgtaatcccagcactttggaaggctgaggcaggtggatcacctgaggtcaggaatttaagaccagcctggccaacgtggtaaaatcccatctctactaaaaatacaaaaattagctgggtgtgatggcaggtgcctgtagtcccagctactcaggaggctgaggcaggagaattgcttgaacccgggaggcagaggttgtagtgagccgagatcgtgccattgcactccagcctgggcgacaagagcaaaactctgcctcaaaaaaaaaaaaaaaaaaaaaaaaaccccacaaactgttaacatattactattaccattattgactctagtaattgtattatttttgacaatgtgtagtattaggtttttgcaaactcatatttttccccctaacaatcactgaactaaaaccagatgtaagcttaattcccattgctgaaagagctaatatggcttccaacaatgcttaataagaaaacaattcattatctatcagaagaacctaatttatgcttcttgactaacttatgtattagtagtttactcgtctgttatgctcttgcatatcaagttaccccaaaaaaggagcctaactagaattactcttgaggagccacagattcttttgaataccctcagcatcgctgtagccattttacaaatcaggaaaatgagacctctggaaatgaaaacgtaaattagaagaaagggccgacctacaatcaagatgttgggtttatgtttttttcaacttagataaggaaaatccagatttaaatgttgtcaaatcatataggtgagtgtttaaacaaagaaaagtcagcataataccaaggacagaaaggtggcaaagaattagcagtaactaaaactcccatttctattaatattgtttatccatgatggaaactgagagacttcctcacatcctttttttttttttttttttttttttttgagacagggtctcactctgtcacccaggctagagtgcagtggtacagtcatgtctcactgtagcctcgacctcccaggctcaggtgattctttgacctcagcctcccgagtggctgggactacaggcatgtgccaccatgccttgctaattattttgtatttctggtagagactgggttttgccatattgcccaggctggtcttgaactcctggactcaagcaaaccaccctccttgacctcccaaagtgctgagactacaggcctgagacactgtgcccagccacatcctgtttttttaaccttaataagatatggtcacaaattgagtcacagaaaactttacttttctaataaaaaatctgcttatattgacgtgtaattgccagacattctggtgtgtttgggtttgcacatttcttctgcttgttggtggctgccttttgagaagtgagctgctctgtacatgcagatgataatgatggcaacttttgtctgaattatgatgcattgcttagatcaggctgtcacctaaatacaactttaggatcaaacagtgttcttttcagttccttggaagtaagcaattctccataacagttaaatccaagttttgtgagtttgtctggcaacccaaacagccttgatctctttctggtttgaaaaggtggactgttgccagtgcacctttgtcttggctgaggaagccctggcctcccctctactgctcagacagctttagaacacaacctctcagatgggcctccctcatcaagaacctttcttgtgaagaatttaattctgcattctggttttgttttgttttgttttgtttttttgtagctataaaaatatttggagccaaaattatttagtaagcagttggaccaatttctttacctgctacctctttttgtaaaggatgagaaaacacaactgcctcactaaactgagtatttgggggaaacaaagtagagttttctaaatctcaaggaggtgtcttttggaagagtctgttggacaggggagagcgtcctgtccaggcttccctggctcatggcagacgctgtcactgtaaatcagatttctaggtggagccctgactggaagcctactgctcattattttaaaggagaaaatagtaatgtattacacataaattctaaatgtccaccccatttcctaaaacataactatgatacagaaaactctcccaattattaggtagggatttgggggagtcaagtttttatcttactctgttttcttgaattcatgattttggtcaattccaggcaggatggatggaaccattatagagaagaaaaaggacaaccttagcgtttctgtcactaacgtattgaacagaatgaaattttttagtttccctaaaaacatttttttcttttttactttattgtccctttaaattttccacagaatgaatgaatatatatatttatatatatatatatataaatatatatatattcattttgtcaggtcaaacaatacagcacaaggcatatacagaaaatgttcattacctcctcctcctcatcctgcagtaattctggtagccataccttatgcttgttaaacataaagtccatataaagccattgtctgctcattgtcaaaacaaaagcagcattacaccatagccacatcactccagagcctgctttttaaccagcgtgtcttaaatacccctcgcaggacacagatccagctcatttgaaataggggcatactccgtggcacgaggcccacactctgttccgccatccccgtgggtgcacactgcagtgtttatagttttgtccttatcatatataaggattgcagtaaatatcctcaaactgatgtttctatttctgccaggcaaattgacagcagtacgatgattaacacggggctgtgtgtcttgcattttcttcagtggcaccacatgactggccatgtgaagccagtgcctgcctgcctgtgaggagacgcaccctctgcctaccccagcactgggtgttgtcactctcctcagcgcctacacggagagggtgaaactgagaccacgtcggtgcgtttcccttcctttactgttaattagatgggagagctgcacatttttatcggccatttgcagttctttttctgtgatttgcctttttatttaaagccagcctggttcagaccaccaggtagaacacaaatatgttggctcggccaaattctgttaagcaagcatatcaagatgatactgcttcggcgattccttcattcaggggtgattacaaagagttaagtcactgaggttttagagcaaaatctatccaaatattaaacacaggtccataaacataatcactcacagcaattagtagggtgtgctctgaatcaaggctctaataaaaagacagctattaacacacatcgttttcaaactagaatgggcgcatcacgcactttactgactggagtgtgactcgtgtgcttgagtgactatgctaagcaggatgggtcggttcttcattggttcatgtgaatttgctgctgctcctggcggcctggcctgagtgctgcagcagcttccccaccaccacctggcgggatgaatgacaaacaccgtgccatggctctcggccaggatgtggtactggcagaagacctctcactgcagtgaaacgcctttccagtgacatacagattcgtgttacatggatcctgaaaaaagataaggcatgaggaaagctggtcaaagccagcactgctgcttgagaagggaggagccactgagaggcgaactctcctattcagagcttcctggctccatgatggaagctacgagcaccctctccacacccaggggtgttctgcttccccatgattactggacaggaacccctctccagggctccattgatgtggctagaattggctgaccacctggatggaaaagcctttcctcttcacaaggggcataagcacaggcacggcgtctggcccacccagtaaagctgcccactgttctgctgagcccaggcctggcttcttgcacccctcctcagagccaacgtggtcctgtactcactccaacctcagccgccctggcttcaagtgttaccagctgcgagtcctggtcctctctgacctcggctgcctcttctgtgcggggaggggataattttgtacctgttttgtagggctgttaatgaggattcaagtgcaagcgaaacagcatcattccagccactgcttttcagcctttcccactcctctgcgccttgcccgttggcagcctttcaggagcacactaggccccacctctgggccgccgcctgggatcactcccgttaccgccagtcctctgaagtcctgtctgcagtcctggcttcacctccactcctctcctctctctgccatgtgctgccatccagggcctgcccggcacactcagggttcattcgcccctttgtatcttctcgtgctctgatgacgcgtcctctgcttctgtgcctcctgccatctgcagctgctcctcctcccctgcctgcctccacactcagagcttcctcccttggggttctgacacccaaatgtgtaccttcagccaattcctctcccggagcttccaccttggatattcaaggacctattgaatatctctgcttggttgtgcctcagacactccaaatccacacacctcaaactgatctcttagtaaatcctccagaaatcatttcttctcttcttttcatctgaggaaatggcatgtccagtattgagggggtgtggcaccatggcagggctttgccaggtgtgggaggtggggagatgaggaacggggcctgccggtgggtcctggacaaattgaagctcagggtgtgagcgtgagatcaggaggctctgaggtgaatgtaccctccctcccttctcccttccccctgccttctgccagctcctccgcagtctccccgggtcttcagcctcttccctgctgctcttgccccacggtcaaccctggacaaggtctgcaggagctacaccaagcaagcagaaaaagtgaaacctctaggaactgctctccccatgtcccttcctgtccctggacccagttgctgggcttcacaccagctctgcagagaagtggcccaaaagtcatggtgaagggacaggccttgaaggggttgttgggtcggtgggaggcttacgcccccactttagttttccttattaatagcagtagccttgtttttcttggggcaagacaggagggagattaatgaatagacatcaagtttgaaaagcacccactgggaagcacccactgtctgggatgtgcaggtaaagggcaggtggctctcgggggcagctctactgtatcccagagccagcagttggggctcagagacagacatgtgcccctcatgctccctccagggaggggaagtggagccccaattcactgacacaagaggaccttaatatatgttcctttagaaacaaatgtagctacacaaaatggttgtgtctggggagtagtggggctcaggcctgtattcccaacattttgggaggccaaggcaggaagattgtttgaggccaggagttcaagaccaaactgggcaaaatagcaagacccccatctttacaagaaaaaaaatagccagatgtggtgacgtgcacctgtagtcccagctactggggagactgatgcaggaggatcacatgagcctaggagtttgaggttacagggaactttgatcacaccattgcactctagcctgggtgagagagcacgactttgcatctttttttttttttaaaggaatctttgattcccagtcctgctaacctatccagtatcacacttaaggtccagtgcatcaactaggccataactaccatatatgaaattggatttttttcttttgagacagggtcttgctcttttgcccaggttggagtgcagtgacgtgaacacagcctcctgggctctagcgatcctcctgcctcagcctcccaagtagctgggattacaggtgtgctatcaccatgccaggctaatttaaaaaaaaaatttttttttgtagaagcagggcctcactatttgaccaggctggtcttgaactcctgggctcaagtgatccttctacctcagtctctcaaagtgttgggattataggtgtgagccactgcatctggccttgaaattgttagaaatattttcaactttcaagcaaccgattataattagttattggatatttatgtgccaagcactgtgctaatcactgtacgtgtgttgttgcattacaagaacactgtgaaggagataggcccattttacagatgaataaactgaggttaacttctctgagatcatacagttagtaggcagtggcgctgggaccgaaacccaggtccgcatccctattgtgaggcatgattacgcgtgtttgaacatgcctatttcttcagttagggactgggcatcacgaggccttttccatcccgttttttatcgctccctctttcttccatcactagacatttgcttattctttttgaaagcaatttttttcctgagcatttctgatttcttaaggtgagttgaagtggaagcatattcacattattttgcaaatgagcacttggtaaatattcactgattctataaattattagccactgctgtgaccatgatgagaagtctcacaaattggattagtgattgcattttgaactttttttaatcttcttttttcagtgagccatttctgtttaaaattttgtttatttctttctgaaaggaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctggtacgtactgggttttgatgaagggaaaaatccttgaaggagatgcttggaatcatttcttttagtcagagaatgaaagggggggatgtaaacaaaagagcaattggaacctttatatataatcgtgtatttacattttatttttgaaatcactaacatagggggcttttctgcatccttggagcatgcagggagagatctgaggtttacttgattgatatgccgtatatcacatgttcacaagaattgacatttgcacaacagactttttaaaaacagtatttcttatttcagcatggaaaataagtttttggaaatgaacatatgggtaagaggaagaatcaattaaaaacattcaaaaaataaacttgtagctcttcactagaggaaagatgaaataagagacacaaaaccccagaaaaatggttaaagcagcagaaccagctaagacttctgtaagttttcttttggtgtgaggccacctgccttcaccctcccctgcgcggtggcgcctggctcccttcccgctcaggactgtgcagctggggactccagcccacgtggacatccacctcctggcccagtgtctggcaccctgggctctcagtggccctcgccaccactgactcgccagtcatattcctttgtgggaggcagctctgtgggattggagcacattttgtaaggacaggaataaagaccaaggcaccctgaaaaaatgattcagaaacctgcaggtgccatggtcccgcagcctctgtcttccaggagctccagtgaactctgccctttttccctttagctttcgtaatctgcagggatgtggcacagagattgccttccacttcttcctgcttcctgcaagtggagaaagtgagttccaagagccacagtgaacggtccggtctttagttagtggccgggacactgggaaggagggagtgttcaccctcgcccttgagctgagactgaggaagtccctgaggttggctgtgcccacttttcctgagctcatagaacccctacctcctagaggccttcaacttgtttagttcagttgggacttctgtgttctttctttctctttctagttggagactgtctaagggaatcctaatggaatcagttgccttcctccgcgatcccgtttctccccttgtttcatggcccctttcacccttccccttggcctcccagggcgatgtgcatagggttgcaggtgctgacagccacgctgctctcacctgtacctcaggctgcacacacggatcccacctgacttgaaagtttaccacgatagaagagaaaggaagacgtgtatattaagactgagagagcccaaacagatttcttaaggataattactacctaaccttaccatccggaagagtcatatattaaggcaagaaataggaatgcaccttattttaaaatggttgcagtacaattcaaaataaatcatgactttcagaagccctctgacagcccattcctggtgattcaaggtcataaattacctttattgtctgctaaatctattactaacttacatgtgcatactaggatttcagtttctctggtcccttttcagtggcaaaatgatagtaactgggctatatgcttgcttccagggtgcttatgacattttccttaagtcttctccctattgaaaaattctagtcccattgccttttttccagcctttccttaatccttggattcttccctgaaccttctccatgtcctttttgcctgtggccctcatgcctgagcagcactgtggtgagcacagcagatgcaagacagagaacgcaggccgtcccattgcacataactgtataatgctcagtctccagtttgtagtttacagtaatctcccacgagtcacacagctttgaagtcagttgacttacaaaagcttttatcgggatcatgtgtgcagaaattcagagcttccattatggctaaagggggattctagagggtgttatttggtttaatttattgtggcattggcaggatgtgacctctctgtgcctcatggttcaaggacgtaattacaatacagacgatggctggaagcccctgattggtgtgggctgttctcctcagcatcctgggcctgcagtgccagaaagccaggcaggccgcaataggcctgtgacgtggctaagtgattgcaggggtaacctgaagagcctgcttcctaattgcatcatctgattcatttatcgcagtgcagtatcttggtgcagtgacaggactgtacagaagtatcagagagatctctaagactcagatagcacgagactgctgcgctgtgctccagaggaaacctgatgcctattacattagagttggattctgagagtaattaaagtgtgatggtctacataacttgtgttttatatagagcactgttaattatatttctctctcttgggactatgcagaatgagtcctggaaattctatagttaccaaaatgtaacaaaaacaaaagataaaagtgtggtacaggttgtacaaagtgaaatgaccttcccaaatgttctttggcctcttggactcgcaggtctgatattttccattaagaccatgaataatgagggattagtctcttattacctgagttccaaatgactatgtatgtatttaacatctaaaataaaagaaaagttttcaaaacccgttcacttttgaggcttcccctttggcttccgtgcggtggactggactgctgtcgagtcatgctgtctgccacggttggtagctcctacatcaagtgaggtattagccctagattgtcatttactgtacagactgaaacttttcaaaagcagatggtcttgtgttttccttgacagcatgggcacgggaagaccataatccatagcttcagacctgaccttaaaaaccgatgtcaccgacagcagtgaaagccacttgttaattatgcagccttcttggcattgttcggtttcccaaggctggccccaaattagaaggatgttatgttttccagttacaattttgtttgtggagcccagaaagctattctttggattccacattggaatgaaaagtgtctgcagggtgtcagggtggcactgtgcttggctggcaagctgcatgccagggccggaaggtacccgattctcatgccctcccatttgctggcagagcccgcccgcagctgggtccagaggagctagcctcaccttcccaggcagacttgtccccaaaagaaaggagcagaggaggcgcccaggaggcagagttgtttctgctaagatttgatatcagaatatgcttcattttctctcctacctaaaaatctttatggcttaattcaaaagattactttatctaataagaacttaagaataaaaagcatctagatacctcagtatcctcctcaatatgggataggttgtgtttttttccctcattctccaggtagcaattgtagcacttcagaaagaaaaagaaacttcctttacacagactcccagtatgcagctcctccttggtaaaatattgtgctgaagagttcactctacatcctgggtgatattgtcagtttgctgtgcttaagtagcttttcactaacatgccagggttttcttttcctgctttttcagtcttttcggcacttccttttgagctctttaatgtggtgcatgtaattgaacaagagctgaagtagataatttagcagtagtccagtagtgctggctgatgtgtatggctaaaagctgggaggttctgcatcttggactggagttgcactttccagaattagcctcaggggggcaccagatcctccagcatagtctctgtgaagaaagaggcccacgttgcgagtttccttgcaatggaattgcagttggggatgcagaccttgtggccagagatgaagggagagagggaaaaacccaaaaacaaagcaggggtggacgtaggggtcattgccactcaggctgagctgtgaagcagcagggggctgaggagctttcttccagcttgggctacccgggctaattggatagaggccactgggcaaggctagaaggacttcaggcaggggagggggtgctggggatcctctgtgtccaaacacagagaagagcacatgtaaatttaagacgcaaaagtacatttggtacttgttaagttcttaagcccaggaatgacagatttatcactaattaaacaataattgcattatggagtactgaaaaaattgtttgtgtataaacaacatctggtaaagattaaaaagaaagaataatttttccgagctcaaatttgttaaaaggaacctgaatgttttaaaacaaaatagatctgaaaatgtaaaagggatatttagagtcttatgtttagtattttgaaaatagaaaagaagcaaatggcataataaaaaatacatatttataaaggtgcctcattgtacatgatagatgtgaaggttttgtataaataggtttttctcaagccaaatcatttttcacttcaatagaggagttcactggtgaaatgactcttatggagaatcttctttttaagaagaaaggtattttgtagtgaatatgcacatattaacaacaagggcttcccactgtggagagaacagtggctcggaaacagctacacggtgggacgggattgtccggctgctgggtaaactggaggggaagctgcccatcagctgattctttaaatgacccatttcctaagtaaatatttaagctacatgcaagtacatgaaaataccaggaaagaatctattccaggcttaatgaacttcagcttctctgtcatctgctatttccttctttatttttaaggcgaatatatctatgaaaggtgatagatggaaagcacttgataattttttctgttccttcactgcctttttattttttctaaaagggatttgcttttgtctgtgagttaccttaaatcatagtataatttccctttttggtttgttttctgtccctctccttttccctattctctctctctctctctctctctcacacacacacacacacagaatcagcaaatgacagaaagaaatgcttcttcctgagaattctgttcttcttgttctcaggcctctttcaagtggcaagtggcttgtaataatcattggtgagttggtatgaaaataacagcttaagtaaacatcaaggaccgggcacaagagcctgtgtaatttgcacagttcatggtgcagagtgacaagttggcctctcccttgcctctcttccaaaacaggcactgagaccatggttattgtgtgttgattccatgttgactttgtcttcccttgtgttttgagggatgaagatgggctttctttctaggtggaggggagataaacaatgcaattctgggtagccatgaggggagatcagagggaaagctcttgttagcccaaggggatgcacacccagcagaacaatcgggtctatacaagagggagggcagaacccagagctctccatcttcgctccctagtcatcctgggcattcagtgaaaagcctgaggggggagataaggagggaaggacaagactcatgttattgaagacctcctgctgacatagctcccctcgagttgaaatgatctgcctgtggaaattgttaggccagatggagaagagagagcttgagaaggaacagattttggtaggatggagaaaaacaaacagatggaaaccacaaaaggtttattttatttccccgcttttatagaaaagataatggccgcagtcatggggcttcagagccctggcttgcagcgtgacctctggtgtgttaccggagtgccccaccttacaaataaaacaggatcagaggttagatgcctgcgtcatcactcatgaagatgctacagagatttaggggggaagatacggcttccaaagaagcgtgtattaaaaccttaattctatttggaagattatcttgataagaaaagcagcttaagattgcttttgtgatttgatgtcgctgggacatatgcctgacctgtagtactctagtcctcatgaggggactcactgaccctgaaattatgtgctcaaaaagtataaagagtgtcattttaaaagccatcggtgaggggtgcagatgagaaggagcagttcacagctgtaggggtagcaagggagactggttttcttttttttcagtgaggtcaggagatcgagaccatcctggccaacacggtgaaaccccatctctactaaaaatacaaaaattagccaggtgtggtggcacgtgcctgtaatcccagctactcaggaggctaaggcaggagaatcttttgaacccaggagttggaggttgcagtgagccaagatcaccactgcactccagcctggcaacagaatgagaccctgtctcaaaaaaaaaaaaaaggagactggttttcaaatcaaaatctctgccgttgctgtttctgcaggttcccctgcctcctggcctcttacctgttttaaaagctaaaatgggttgtggaagcaggctgagagtagccaagggtctgaaatatttggaaagaaagaaatctaagaggagagtccatctgtatggggaagaacaagcagattccacacagccagcaggcatttaaaacattggattgagcgattttgctagaaaacagcgcacagaagaggagcagatctaagctctcactctcttctaacaaactgagtaagagctgtcttccttgctcccccagtggttttcatagtagccctaatctacatctgatcatcattttctttgctgtttggaaatccctataattagtattgaatgattctctactagcatcaaacctatagaatggctctgggatagtttgaccatttagaaaaaagaaatttaattttaccattttcaagtttcatcttactttctatcaacgcatttccaagctcttatctgtctgcctgtgggcacataacagtgctatttgatcttaaacactcttattcaataggcatgttgttgtacaaactttgaaaattgctctggcaaacttagatgaatcacatttcttcaagacatacggttgcttttcccttgttttattttttcattatgaatacatagaaacttttatattttccgtgcttatatccggtgacctcttaataacttttattatttacagtgagactgggcatcaggagattaactgacatgcctaagttcgaagccacgaaataacctgcctctcctctcttgaacggtggtcctgccaaattattttcttgcatagataatgaatttatctgtaagaatatcaagttggttccttttagataaaaatgcacatcagtgaaggatgagggagcatagattatttaaagagtaggacattttaacttgcaaattagaaatcttgaaataattaaaaggagatttatcctgtcctgaaaaagtggcagagctcctgcctggagcccggcgggtccagcagtgctgaccagtggacgctagatggcgcgggctcaatgtcatcggggaggccgcgaggaggcgcggtcctgcctcagtgtgatccagggcacggccggagcagagcgcctccttttttcttgccgacgggggcctgtgaacagtgtttcccaaagctagtcatatcaaatgcactctgacttgaatttccaatagcgcctgatccactaacatgtgaatgctgctgtgaagcaggggtccccgccccctgggcgcacagcggagaggagcccctagccttcccgcccgcacctgcccctgtcagagccccgcgcttcgcttcccacggaaccagagccccatcctgactgcgcatgcctggaatcgggttgtcctctgatgatctgaggagcaaccgtttcatcccaaaaccatctccccctcccggtctgtggaaacattgccttccaagaaaccggtacctggtgccgagaaagttacggaccctgctataaaggatctgttttggaacacaaatgggcattttcatctggcatcatctcatactttgagctctggccaaaaagatagggaaccagggactgggccagtgaagctccccccagctcccagggctaccggaggccagcttctgcagactcaaataatcagaacccatcaccgaaatattcaaggagaaattagataacttttattcttcttcatgaacccccttttcatcttaacgcaagctgttaagtgcattaagatgtgatgtgatttagtccagcgtggtagtggtcactggtttgccaataataattctaaattgttatgtacccattaccgaataaacaggctgcaggcacgggcctgacctcgaggcacatctagccatttgaggaggtcacacaggcacacttcagtagaactggcagtacaggcaggctccacggcatgcgggcagagggatgtttaaagtttctctaatacttactgattctgtattatggatcgcctgagcttttatagaaaatgtgggacatacaggagtatacagaggaataagctgcctgtaacccctgcccagggagaccaccgtatgcacttgtatgtggggcgttttcagtacagcagtggttcgttcttctaaccaaaaggagtatgccagttttctggacatcagcagttcccagtaactcctttggctgataatagcaagtttctgagaaagtgcttgtgatatttcacattctcatggtcttctccttttacagcctcaagcagcctgccaccctgccatattccgggttgttgatgagatgttcaggtaaacgttacactgtttcttctagtaattgatgtaaaaaaggttccatttccaagcatgaatcagaaaatgttgtggtagtctctggctgtatcatggggaaattagagtttctgattccctcctgttcctctgagctttttggtaattagaggtaaaaactcaaaaatcagtgtaaatttaaaggccagtgcctaagaattaagataactttattttctttagccttttaagattctaataatagaaacacagaattgagttaggcattaatatcatgaaatattcatgtaggatttttctcagctcagaataaagggtagcaatatactcccttcaccatgtgagggctgaccaatatttttaaaagactttaaagctaaagaaagccaagaaaaataaaagtcattcttaacagaactcttctgaaaggcaaaatacaccatgcatgttctcttacaacacattacatttttattttgaaaatatgagtacttcttgggaaatgcattagatttacagacggcaagagacgaggagctcacagccatgaagctgagatgtggctggcagttagtgggagttttaaccatggagtactaagttagtgggagtactaaccatggagtactaagactggacgcccctggggagcttgtcacctgggagtgtcccagcccctcttccaggggagcccatatcagctctctctctagcccctcccacctaacacacagcagcagaggctgcagggcagactgcagactttggggaaaggaatttttactgtgacaataactcaccagtagtcagaacagtgttgggggtttaaagctagcaaaatttgagagtttttttgtttgttttgttttgttttgcttaaacaaacataaagaaaaattaattgtacaataatgcatggaagcgaaaccaggtacacacacattattttcctactttgctgggtggatggacgaggccattttaccctttgagcagcttcgtctccacttgtgaaagcaaaatgttgatgttgcgtgtccaggcatacaatacaaaaatatttgtacagagtatgcaagcctgtgtggaagggatttgcattgcttaataatttaagaaccaagaaagagagctctgcacgttgcaattttaaagaaaatataacagggagcgacaaatttatcctgttttcacacaaggactgaaatctgatgagttgagatactgctgaagcttatggcacaaaaaaagtgtttctacttttcccttatacagtgcaggttttcatgtttgccggattacttgttaaacgtgttctgatctgactttgcattgttcaggtgtgcactcctggaaaccgatggggccctggaaatcatagccactattcaggtgtttacgcagtgctttgtagaagctctggagaaagcaagcaagcaggtttgttatatcacatatattactcattcatcccagagaataagacgctgttgagagtattttggacaagagcactttattttcaataattttgatggactgttttgctcacaaagaaaggttcctaatgagtgccccaacaaaggttaagccattttaacttaacataaatcaagatctgtctgccccgtgccctgatacccagaagcatctgtctactattatgtctgagaactctgtcatgccagcatgcatggccctggaggacggctcttcttggccctgtgttgtgcactgtctgccgagcaggacactgccccctggctgcatctgagcctcccaggtcagcaggaggcaccctggggtctatatggcatgtgatgaataggaaagggcacttattacaaagcactcctggacattcttaattattagcatcttcattcttatcagagacccaaatgtgaattggcttccaggaaaggaggtggtaagagtgactgggaaaggcttgactaactagaaggggagtgaggaagggcagtgagcgggaggtgtgtgttagacacagtcagtaaaccaaaggccaggcccgcaccctgcagaagattgtgctccacgtccccagcagcagaggctgggcaacagctgccaagagtcaatgaccaattagagggacctcgtgaaacagggacctttgctaccagcgagctttcacctttcagcatatatatttggccttgatttctaacggccacagaagtaatgtttatgggacacattgcctgtcgagagtggtgctggtccagtgcatctcatctgtagagtatgtcacggcccctgtgaagctctccgcagtttgacttccgagaggagaactacaatgcttggctccaccagatcacaccccccgccaacgtcaaatagatctctcaggttttagccgatatttctacttttttttttttttttttttttttgagacaaggttttactctgtcacccaggctggagtgcagtgatgtgatctcagtttactgcagtctcaaccccccaagctcaggtgatcctcacacttcagcccctgcgtgtagctgggaccacaggtgcatgtcaccactcatggctactttttgtattttttaattaagtacaatttccattttatttttctcaagagaatagtccgtcttcagactttaaggactcaactccttacgtgggctttggtgggggttgtggggcagcatccgcaggtctaaattggagtaggggtgttcagtccttgtgggcttcacaagatcgattcctgactactttgctgtgaattgcacaactcagacagtaatgtagcttcaaatacagcttgggaagcacataggcatcaaagacgctcgcttcagaaatgtccctgactgctgcagcctccactgtgtttccaatgatgaatttgttaatagccttgtccttgggcacacattgggcacagttcgtgtcgcaaataggctgcacgtggccgcggccctttttggtacgaccgttgttccttctttttttcatcatattggaggcacggactggaggaagcactaatttttgtatttttattagagatggggtttcaccatgttgcccgggctggtctcaacctctgaggctcaagcaatcttcccaccttggcctcccaaagtgctggggttacaggtgtgagccaccacacccagcctgtttctgctttttaaagcaacaataaatatatttttattttattttattttttgagacaggctcttactctgccaccaaggctggagtgcagtggtatgatcatggctcactgcagcctttggcttcgtgggctcaagcgatccccccacctcagcctcccaagtagttgggaccacaggttcaagccaccacgcccagctaatttttaaatttttttttgtagagatagagtctctctgttgctcaggctggtctcaaacagctgggttcaagggatcctcccaccttgccctcccaaggtgcttggattccaggcttgagccactgtgcctggccaacagtaaatatttgtgatttattttttcccaccctcactttccctggagaagttagctgggctgtagcaagctgcgctatccatggtcccacctagaattttggaggtggctcggctggaaggcacagctggccctcacggttattttgagcctaactgtaaatgtctctgagcctcccttgtgcattctttgtagaccccattaggaacgggcctctggggagtctcacctgtggcctcgcggagcacacctgggttggagcagaggccacggaggagtgccactgtgctctttagggttagctcgcgcctctttttcttcttagcttcaccctcagcctctatgttggccgtgggcactatggattgggactgatgttgcagttgcttttaattgagactagtaccctgaccaggcatacgtatctaaggacgtgggaccacacactgggtcctggtgtgaggcaaggcagggatccaaaaacaaacaggaattcaccaccctcgccttcagctcaacaaaggaaaggaaagtctctttgctttgccaatgcctgcataggtatctgttagtttatttctcttcctagagctggacctgagtgcctgtctttttaactgatggccatctacatcttttgaccctctgccttcttgactgtccatttttagctaatcaaaacccttcatgtcatatttggtagatgcgtgaccctcttttctctctgtgttttattcattaattccttcttaataaaatgagtatctgtaaacctgatatctaataatctgaatatatgtctatccacgtgctcctccctgcctctctccctccaggtaacctctggtttgaattttatgtgccaggcgtggtggctcacacctgtaatcccagcactttgggaggtcgaggcaggcagatcacaaggtcaggagatcgagaccatcctggctaacacggtgaaaccctgtctctactaaaaatacaaaaaaattcgccgggcatggtggtgggcgcttatagtcccagctactcaggaggctgaggcaggataatggcatgaacccgggaggcggagcttgcagtgagctgagattgcgccactgcactccagcctgggcgacagagcgagactccatctcaaaaaaaaaaaaaaaaatgaattttatgtttattatccctttgctctttctgaaagtagtttgatcacatatatatgactgcctaaacaatgttttgtttagttttggttgtttttgcactatataaaacaaacaggagcagcatactctgtgcaatcttttgagacttgcttttccactcagcagagacttcttgacgttgccatgtgtggctgtggggaagtactgttatgcatagtccattgtgaaaacgtatggcagtgtagccatcctcctgctggtaggcacttgagatgcttccaggttttgttttttattacaaacaatgttgctctggacactctgggatagatacttaggagtggaagtgtatttggaatacaaaagttcaactttcatagatcctgccagactcatttcaaaagtgttggtgctcatctgcacttcctgcaacagtttatgagtgatcccataaatccacattctctcctatcatcagaagcactcatgtcagtgcttctgtctcttcttaccctttcctcttgtccctgttctgtttggaggacacagtcagctccatcaatatgccctatcagacagtaggcagaaattgaaatgggtgtgacaagccactttttctaagcctgcactgtggctcagtacagccagtcaggtcagtttctggttgcagccatgacagcatctggtaatgagctagattaaatcatctcccacagataaaaatgataaactccaggcaaagtatttttaaaaatctatttgaaggcactacagagcacctgaaaaagtggacagaaactggaggccatcagccctttaaagggacatcacacagagaggtctcctgcctccccccagctgccctcatgtgaggttggaaggcaggcagtgtggggccaggagagggccagaacttggcacaatctgattgacttaaggtgccaaaaaatagaagtgtaagctgccaaaggaacaaaaaaattgaggggaaaaaagaaaaccaatgtcaaaagatagacctaaacccaaaactaccaacaatgacattaatttcagcaattaaatggaagttaaatattctaataaaaaggcagaaacgtcagattgaacaaaaaaaatgaagacctggctgggcacggcggctcatgcctgtaatcccagcactttaggaggccaaggtgggaggattgcttgagtccaggagttgagttcaagaccagcctgggcaacatagtgggaccccagtctctacaaaaaagtaaataaataaaaaattagctgggcatggtgatgcatgcctgtagtcccggctactcggggggtgaagtgggaggattgcttgagcccagaacgtggaggctgcagtgagccatgatcacaccactgcactccagcctggaagacagggcgagatgctgtcttaaaaaaaaaaaaaaaagattttaaaagccattgtaatcaagacagtgaggtattggcaaaaagacagccatagatagatcagaattgagtccagatatagacccatacatatgtggccaactgatttttgacagagatgccaagacaattcaatggggaaaggaacgttttcaacaaatgatgctggaataactggatgtccatatgtagaaaaatgaacctcaaacattaccttgtaaagcacacaacagttaatttgagaggatcatgggcttcaacagaaatgttagaaagataaagcccctagagagagcataggataatgtatctgtttgacactgaggtgatctaagatttctcagaagcactaaccataggaaaaaatggataaattagacctcatcagaatttaaaacttttaggctgggggcatagctcactcctgtaatcccagctcgttgggagccccaaggcaggaggatctcttgagcccaggagatggagaccagcctgggcaacaaagtaagaccccttttctacaaaaaatacaaaatttagctgaacgtggtggcacacacctgttgtcctagctactcgggaggctgaggtgggaggatcacttgagcctgggagatcaaggcttcagtgagctgtgatcatgccactgcactccagcttgggcaacagagtgaaaccatatctcaaaaaataagaaaggaatgtaaaatttctattctttgatagatatcattaagaaactgaaaaagcaggccaggcacggtggctcatgcctgtaatcctagcactttgcaaggctgaggtgggtggatcacgagttcaagagatcaagaccatcctggccaacatagtgaaaccccgtctctactaaaaatacaaaaattagctgggcatagtggcatgtgcctttagtcccagctatttgggaggctgaggcaggagaatcgcttgaacctgggaggtggaggttgcagggagccaagatcacaccactgcactccagcttggcaacagagcaagactccatctcaattaaaaaaaaaaaaaagaaaaggaagaaagaaggaactgaaaaagcaagccgttagctaggagaaaatatttgtaatatatgtatacaacagaggacttgtgtcgagaatatatgaagagctcttataactgcctaagaaaccagtttttaaaatggacaaaagacttgaatatatactttcaaaaaagatacataagttggcagtaagcacatgaaaactgttcagcgtcatttgccatcaggaaagtgcagagtgaaacaggtaggaaagcaagcatacatagggttatgttcccagccactagaatggatgaaatgctggggagtatgtggagcaactggaattcacatacattgctggtgggcgtaagatggtacaacaccggaaaaccatatggccttacgatgttaaacaagcatctatctgtgacccagcagttccattccgatggcatccccaggagaaacagaaacacatgtccatgaaaagacatatgtatgcatgttaactacagctttattcatgacagccccaaactggaagcagcccaaatgcacatcaagaggagaatggctaaacagactatggcatattcatacaattcagactacttctgagcaataaaaacagaatgatctactcgcacacaataacgtggcttaatctttaagaaaatatgttgagcccaagaagccagacacaaaagaaaacatactttatgttccctttacacaaaattcaagaataagcaaaactaatctctcttgtcaaaatcaaaacattggttgccagggtggggtggagggaatgattgttaagaattggaaggggactttttggcgtgatagaaatgtgtcttcactggggtggtggtcacatggatttgcacatttaccaaaacctcatatacttaaagcccatgcactccatgcgttatagattttacctcaatttttaaaaaagcttctgtgccccttgggggcatagatagctgtagctctttggccctcgaaatgcgagcacagttttacacttttgttgttattttaaaaaccatgctgagccaggctcagtggctcatgactataaccccagcactttgggaggccgaggcaggtggatcacttaagctaaggagttcaagaccagcctggccaacatggtgaaaccccatctccactaaaaatgcaaaaattagccaggtgtggtggcatgtgcctgtaatcccggctactcaggaggctgaggcaggagaatcatttggacccgggaggtggaggttgcagtgagctgagattgtgcctctgcactccagcctgcgcaacagaaggagactccatctcaataaaaaaacaaaaacaagccgggcatggtggctcactgtaatcccagtactttgggaggccgaggcggccagatcacctgaggtcgggagttcgagaccagcctgaccaacatggagaaactctgtctctactaaaaagtacaaaattagtagtgcttggtggcgcatgcctgtaatcccagatacttgggagacagggaggagaatcgcttgaacccgggagccagaggttgcggtgagctgagatcgcgccattgcactccagcctgggcagcaagagcaaaactccgtttcaaaaaaaaaaaaaaaaatgctgaaatacctaacatctcacaacggctttggcaagtctttccaaaacagaagatttatttgtataattgggttcatgtgaagtagaactcataaagacatcaagagcataaatttattatttttaagtcccagaaggtgactttaaaaaggttaattattctggaaaatatgaggttattgggagcttatttttcaaaaaataaatgtttaagaaagtgttctgaccatgttagtactggtgggtcttttttgggcagaggactcagagttttgtattttcctgaccccgtttcaatcttaatgttcatgctctttggattttccatcctgtggcagctgcggtttgcactcaagacctactttccttacacttctccatctcttgccatggtgctgctgcaagaccctcaaggtgagttagggttgactttgcccacatcagaatgatttcctgggaagagcattgtcaaattatgacctcctcatcaggcccttatctacagcatgagggagacagaactggttatttctaagatccctttaagcccccaggatcccacattctgtggattttgatatgagagtctgcttggcttcccagttgtgatcacttaccaaaagaagaaaacaaacaaaaaaacaatggcctctggtaggtgttgctagtctgcctccagataacacaggctcttctggtgccaaccagatccaccagatgccaggaacaggctaagacttggctgagtcagaataaaacagtacattcgtttgcttttcattctttctactctgtgcagccttgttgcagaagaaaagacaaaatgatggatgaagctgaggaaatgcaggggaagtttcccctaaccaagctaagggaaggattttgagagagttcagtaaggtgcttcatccacagcctctcctgatatcctttgccagccttccaaaggctatccagctggggaagtgatggttccagccttcattcgactggtgttgatccaggaatgtggctgtgagctcacgcttaggagacatttcggaaatagagaataagggcatcctttccctctgaggcctgaaacctgatggaaggcagtcctgacatgggcacagactgcgccagccagaaaggggccttattggagcatgggaggagaggagacagaagggaacgagccagtcacatttcctttttatgccattttgggcctgccttttttctgagacttgagtgagtagatctgtttgagaaatgcaaatgattcaaagtttcagagcattttacaaaacctaaattcctcttcctttttcgagaagatgtaggttcttgcccagggtgatcccctaacactgtcttctcagatgctggagctaggggtgggatctctgggtgacagttttatgaaaactcttgggaaaactttattaacaagacagaaaaatgaggaattcactctcccagggttcaccttacgcttaggtcagatcagcaaagcctaaagtcagccaacaggggacgctgagtgagctccagaaaatgtactggagttgttagtgtctcagtttggaaatagtaaataaacggtgaggtggtgcatgggcatgggcccaaccctttacctttccgtttgtgtaacttgtagatttatgtccaaatataaataggtggcttcgggcagaagtacaagaacctcttgtgctagttcctagaagagctgtctgtatattactttgggaaacagtgttatggtcacagattgaagaagtgttttttagtggcatgatcttctgtttatcagaaatttatttcatacccattgtgaaggccgggagaggggtgtaaaagaggatcacttacgagccctgactgtgtagacactacaagtggaggaaatgcgaaataaacatctaaatagctagtaaaaggaagaaacgaaaaataccttcaaaaggctgtgcaccaagggccgcgggagttcagaggagggaggcgctggccttgtggagtagcagcagtttgtccatcactcgccttaccttccttgtgtgttcgattatagcatctatcactatgtgaaaacttttgcagatgctgcacagaactgcagatacgtgctgctcagctgtatttaaaaccacaggatgactgtgaaaccagagcagctcactcaagaaaagacatttgtttgcataatgctcacttattttctttcctggcctttttttccactgtaaacctgaaatcatattgtgaattcatcacagccctaggaaagcagtcaggcagtctattcctaattccttattggctgctttactacagtctccgtctattttgaaatcaacacattagtgatggaggagtgtgtaggtagaaaagaagaaacctagggcatccgcaacccggcatttcccagtctcagcgggggctgcttatgcaatctctagctacttccatgtacctgaatttaaaattacttgagggcaagcgtggtgattaatgcctgtaattccagcactttgggaggccaaggcgggaggatcacttgagcccaggaatttgagacaagtctgagaaacatagtgaaacctcatctctacaaaaaaattttaaaaatagctgggcatggtggtgcacccctgtagtcccagctactggggaggctgaggtaggaagatcgcttgagcccaggaggttggggctgcagtgaaccaggatcgtaccactgcactccagcctctgaccaagcaagatcgtgtcttaaaaccccacaaaactaaaattaaaagattagattctttgatgttcaactctgtgtgacatggacagatcttacttccccaggcttaagagataggtactggctgggaaaagcatgagaacagtattgggttccgtgaaccagaagtaaagggcgtctcccaaagactcttcaggtcatccctgcaggtggttcctcatgggcttgacatttcctcagttgccctctgacgtatctctctccacccgcagatatccctcggggacactggctccagacactgaagcatatttctgaactgctcagagaagcagttgaagaccagactcatgggtgagcaaacactgaccactcccaaatctacttcacacatggtttccctagatcctcatctgccctttgagcagggctgacagaggaaggcattactggtctgggaccatcaccaaacaggtgagcaccatggtgaagtgagaagtggaggaagcgcatggctgcacggatggcttggagcaggtcaggatgaataggcatgcgcatgtatgcatgtgccaatacctgtatcgaaatgttttctacattaacgtctggttttagattttgaaatatacaggcataacaataaaaagaagaggccttggaaaaagcagcacccacctgctgggaacccctccctggccgcacagaagggaaagggcacttgtttgggtcctgtggtcttccctctacctctctagggaaggagatttgaaactcctacacagtagggtggaatgttaaatgcttgcttttccttctctctaataaatctctctaaaatgagaaaatctattctaatataaattctgggttggttggtttgttttaaatttttagagataaggtcttgctctgtctttcaggctggagtgcagtggaatgatcacatctcactgtagcctcaaattcctgcgcttaggtgatcctcccactcagactcctgagtagctgggactacaggcgtgtaccaccacacctagctaatgtttaaatttttttgtggccgggcgcggtggctcacacctgtaatcccagcacttggggaggctgaggcaggcagatcacaaggtcaggagatcgagaccatcctggctaacacggtgaaacaccatctctactaaaaatacaaaaaattagccgggcgtggtggcgggtgcctgtagtcccagctactcgggaggctgaggcaggagaatggcatgaacccaggaggtggagcttgcagtgagccaagatcgtgccactgcactccagcctgggtgacagtaagactccgtctccaaaaaaaaaaaaaaatttttttttttgtagaggtcttgctgtattgcttcaaattcatgggctcaagtaatcctcctgccttggcctcccgtcgtgctgggattacaggtgtggaccgctgtgcctggcttgttaatttcttaacagtagtgttaggtaccctcttatgtgtgtgattttcttgaaagcattcacatttatgccttgctaaattccttgtatcataacactctttggcttcctctttcagagtataattttattcattgtccctgctagcctactaagactatcttatttgttccttttgccacttttcactcctggaattctctgtagtctcacaccgagttgacacagacaatgggtgacacacctatgtccagctccgtgattgatggcttgggtgccagctgctcactccttcctcaccatgattcttaccgacagagaccagacaaaaaaggcctgcagccaatggaggctgcggggttggccacatgaatagcctgcagtggccagtcggccccccacacaccctccctggttgtcctggtgttacacagagctggaccttgaagaatcttaactcggggacaggacgtagatgcaggtggcataaacagcccaccctgtgattgagacatgttgtgcagtgggtgccctgggtgtttttctcttctctctacccaccctctccaccatcactcagaatgtgtgatgtcaaatgcgtgaagactggaataaaacagcaaccagaaagggcgcatgtggtgctgcagaacaggacttagacctcgtggggctcccacttcaatccagaccttggagccatgagatacctttcaggtggccacatgggactgcttgtgcattcagctactggtggaagacagagggaaggaccagaccggtctctgatcctgatccagtcacgctgccaacctgggagctgggagcatgagggagcctcactgctctgtgcatctgtctaccctgacatggtgcctgcagggaagaggcatggcagagtcccctcctcactctggtacagcctaacccagcccacagccaacgtggcctccagagcatcagctctgaccatgtcctgggaaagagggacatgtctctgttgctcaaatgtagaacatttaaccacttgttctcagggaggactggggcaggaggacagcagtgtccagggaggcgaggacagtgcttagagcttgggaattccatgggccaggcagaggaacatgcaggaagatccaacaaaggggccaggaacactcctgttccagccactgccccagtccagaaggaatgttctcatctaatgtgatctcaggctggtctgttccatcctctccaagggagatgttcacctgctgagaccggcactgcacacaattagtaggcccttatctcaagcaaattctacccttaaaacaagtattgcaactcccatttgccagtgtggcgaggggatagcttcacaaacacttcaactttctggcattgatgcacccatgatgacagcagctcattaaaaattcgtagttgctgaaatatccacctgaactttgcgtcttgtcagaagggaaatagcccatgtttctgcctgcgtcctaccctccacctctttctccccatctcagaaggcagggaggtgtgccgccacatcctgccacattcctgttggtcatggccgcagtcttccttcttcagtgcctgtcctcactgaacgtacctggattaaagactccgatgtccaaaggcctcaggcctcacgggggtcctgagaggcactctttcgatgtcctgtgatggtgcagagtggcgtttggacaggctttctgaatctaaattgtattccttgcaggttgcacttcagtggataagtacaatttaagccaaccgttggcaaacgttaaagttgctttaaaaacccaaaggaagaagaatttaggttgtcaactgccatgtgttctgcctctgttccaggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtgggtagcaggccccactgcatgtgtttggggtgggctctggggggctgagaggagcttgcagagaggggctctgttgtgggcttggcttccatgacacctgagctctgcccacagatggcatatgtcatggcaacctgcaggcatggtgatctccagccttgtggtcagaggcgttctcctgtccccaccgaggtggccagagacgagacgctgccagcccattctcctgcaaaacgaagacccttcttccccaaggtcatttgatctgttattgctcagctgccatatctgccccagggtcgcgtcctccaaggcgtgccctgcagaggcgggctgttctgaggggtgtgccggcagcagagcctggccacagccagggccctgtctcgctccccagcagcccggccagggcttgcttccatcttgactgtctcctttcttggatcagtcaacagatcctcacattactggctttatttacatctcttactaaagtaatcagatgatattaaccactttgcttctgaaaaagaagttggtcatttcctaaataacagagcagctaagtatgggactggataactgtctgtggcaaagacagttgttattttatgtggaatataataattacaggaagcaatgctttgattaaaggcattggcacctcccttgcaagcattgatttgctaggttcttaaaacttcaactgccagtgctctatgctgatcttagtagttaaagaggacaaggctcattttgtatagagccctgcttctcttggctttggcattttctgttgtttgaaaacacacagactaataaagatgtctgcgtattttgtttaaaggcttgcatggcataggaaagaaaaatagttttagattttaaaaagttgaaatttggtgataatttattttggatcagaaataaagctttgtgaaaaaattataacccacgtatgtatttgaggattgctgtctgattaaaaagaaagctttttatttcttcccctttaaaagatcacgttaaactaaggaaaatcctggttgatgtttttaacagtaataagatgtacggggcacatatggtttttaaagcccttttatattctgtcttatttgattctgaataagctaagttggtagatatgtgttcaattccatcacagtcaaaaggttactgacagagaatcacttttgaagtataaagaaataaattattcaataacacttaatttctagaaagttctacattggcacatcttctactagctaacttggtccttttttatgaaaaaataaaacccttgcgtagttctccctcaggggatgcctaggattttggatgagaacgtattggctcaatgtgagtggggcagtggcaggcatccatttcccttccccccattctgtcacaggtgcccatctgcctggcagttcaatccagtgctcatgttggtgactccagagccccttccttgctggtgcctgcctgaggcattggtgtatgtggcgtcctgggaaggggattttagtttaatgaatgatacgtacctcttgttttcctgggttttgtgagctttaatcccttgatggtctgttgggaggcttgagagacaaactgtgaactgtgttagaaagcatgattcgtatgtgattgaattgaaattagcagtatctctgcatttgtgcatttacttaaaaaggcacaattaaatcagctggtggcgtatccccgcatcgtgtgctgggcctggcgtcactgcctctgtggatgtccttgaggtgaagaacatgggtgcaaagaccaagcgtgtccccgcccaggatgtgtcctgcctgtgagaaggcctgtcccactcatgggcaagccaccctttccaccagcagccagagttcatctccttttgccaacaactgaatcagatcacaacaaaataaaaaaaagtcgtttagatacccttaagaatcagtaaggtacaatgatgcctagagaaaaaaaggaaaaaaaaaaatcaggcaagggttcataccctttaaccctgtggttccacttctaggaattaccctggggaatagagatccatgcaaaggcttatgtataagaatattcagcacagcattgttcataaatacaacaatgggaaatggcctgaactttcaatagtaaggctactggccaaataaagtgtggtatatcctaaccatggaatagcattctgttacataccatgaaaaatcatgctcttggacgggtgtggtggttcatgcctgtaatctcagcactttggaaggccgaggtggccgtatcacttgaatccatgagtttgagaccagcctgggcaacatagacccctgtctctacaaaaaaataaataaagaaattagccaggtatggtaatgtgtgcctgtagtcccagctactcgggaggctgagatagatggaaggatcgcttgagctcaggaggcagaggttgcagtgagtagagattgcaccactgcattccagcctgggtgacagagcaaggctctgtctccaaaaaaaaaaaaaggtcttgaagagcatgttctatagatacagtgaactgaactgcttatagtacattatggagagaaaaatgaaagatacaaggcattatgtgtagtgagtggtatggtctcagtgcgtagaaaaaagacaagaagtatataaaccgaattattaacagtgagtctttttggatggtagagttatagatcattttaatggttcttctttttctcttttcaaattttccatagtaagcatatatgtctttataatgcaggataaaaaatactttaaaaagaaaagaaagcttttatctttctcctgaaaaacttaggacatgtttaaagttagttatcggtgttcaagtggaagcccatgagcatggacggcctctgaagggaaagacagtctgggccagacataaaggaagatagaccccatcttagggattattggacaagggcagaaagtcggttgtgggtcaagagaaaaaacagatataaaggcatagcctcctaaaccctgacatttttgcagacccagttagatggcagaatggccttgggctcccgtagacaccatcagacccggcaggctgggccggctgaggggcgaggtggggagagtgaggcctgccctgctggagcgctgccgctccccgtggaagagcccgatggtgcagtttctcacggtcttgtattgtggtcagaggagctcacacaacacacccagtgtactggagtttatgacagacttcattgaatgaggccttgacttccagggaaaaaaaacgcctcacacaaaatccataaaatcggtcatgggaattctcagaataggcctaagtattctttcagaagtgatggaacatagctgttcacgagttccatgtggcatttggagctatgggctttcggtttttgctttgctttgttttccaagtcacgactgggtgtaccattcttgtagcaagcagaaacatctcagcatggaatgagtattttttatgcaaaagcaacctgcagacttataattaccattattatgtgggttccacagacttgtggcctctgcttgagcattaaacacgtatgaacagattgttccggcatctaaaacaaatgtgttcttgtgtgtgcatgcatgtgtgtatgaccgtgcttgtgtacacgtgcgtgcatgtgtgtgtgttccccccgaccccccgccctgacccccaatatagcaagaagcaaaggcaagcctacattcgtatgggaacactggctcggcggaggtctgactgcgtggggctttaattgatttgtggctgtgataggcgagtcttcaaggagccttttgttctttttcccacaatataaaaatctgactacattctgttgagaacttttctctgtttccttttatacaaaaaaaggtcagttcctggcatggtgccctgactgcttggtgagcaagacgaaagaaagtcaagaaatttccattccgcccatttgggtttgtgtgaaatcgagtgtaaattcggccgctgcctagctccctctctcaggggccagtgcttacccgtttctgggggttgtttcaaagcaaataaataaatcctagaagtatgtctgtcctgcctcttcctaacctctcccctgtgaaatactattgcccaggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctggtaagtctccctgtggtccagcatcctagtactcatttctgctccaggcgagaggtgggttacctgtccgagggtctggcctctgcacagtgtgtgtaccaggatgctgcccagcacagataaatggtcaaggaggttgacagctgggatggaccccagagcctgccccttccagcacctttatgtcatagaagagaaaacagaggctcagagacaggagatgccatctcctgggcccacggcttgctgccaaagcctgcggtagaagccaggtctcctgtccccctacgtacatttctttccatcgcagtgtgctgctctcctcctcctcatggaaagaagtaaggccacgatgagaatgggctcgcaaagcaaccacaatgctattcactgcaacagtgcaaagaattctgttaatctttaaaaaaattggtttattacaaagaaatccttcctgaagcccacttgacttgaggggtaaaaaacggtccaagtcaaaagtgagcactctttgtgacattagatttggcaatgatttcttggatatgataccaaaggcacagcaatgaaagaaaacaatagataaattggactttatgaaaattaaaagcttttgtgcatcaaatgatactgtcaagaaagtgaaaacacaattcacagaatgggagaaaaatatctggaaataatatatatgattagagtttagtattcagaatacataaggaattcttataactcaacaacaaaaagataaacaacccaattcaaaaatgggcaaaggacttgaacagacatttctccaaagaagatgtacaaatggccagtaggcatgtggggagatgctcacagaaagggcatgagtggtcagggaaaggcaaagtgcagcgagatgcactgcacagccatcaggatggctgtcagcaaggagagaaaagaaacgcccgtgaggatgcgtgggaaccggaacactcatatgcttcccggtggggacattaacgtcgtgcagctactgtggagaagaatggggtggttcctcaaacagccaaacttggaattaccatgtggcaggcagttctcctaggtctataacccagagagccgaaagcaggggctggagggccatctggcccagtgctcagggcagcactattctcagcagccagcaggcagagatggcctaaacgcctgtagagggacaagcaatgcaccgtgtgatctgtacccacaagagagtactgttcagcctgaagatggaaagaggttctgacagtgctacaacatgaatgaacctggaagacactgtgctgttgaaataagccagaaacgaggatgttgtatgagtcacttaggtgaggcacctggaagagtcaagtccagggagaggaagtgctagagtttcccaaggcagagggtggggagtcagtgtggggatcatggaaaggggcaggagacggccagtgctgatggctgtgcaacactgtaaacatactgcatgccaccaaattacacaaatgggtaaaacagcacattttatgtatattttaccacaatttaaaaaaatactcatctcagaaaaagcaccagcatgctggctctgggagttttgttttattttttattttatttgtacttttgttgacatatacatacagaaaatacacagcttgatgaatttcacaaaccaacaacacctgtgcagccagcagccaactcgagaggaatattcccagtccccagaggcccctcctgctcccgtccaggccgggcctgactgaaacgtgaatgtccatgtacagaaagtccccgtaacatgacccacctgccaagaaccagggccaggagattgtctccatcctggtaggacagtcctgtggagcgggcccaggctgtgcctcccaggtgctggtgtctcagctaagacgaatccgagtcatgagggtggcccagggctaaagacgactggctgccacatgccaggtgccacctctttgggcccggccccagcacagcgagaatgctttcgagaatctattgtgtactcttataaaatgcacacctgcaacaatgcggcccaacctagagggctttacactgagcgaaataagccagacgcgagagacaaatgcatgctctcacctatgggtgggatctaaaaagtcgaactcacagaaacagtgggaaggtgcttatggggggctggggaggggcagtggggagatggtcagccctgccctgtgacaaggacaattccagctcaggcacttcctccccaaccctgtggcccgtgtgagtggagaaggcttagcagcaggggtcagcgtgggagtttggtgactccagccctgccgacagggtgtgagagaaaatcacccagagcaagcaccctagagacacccaggtctctgcttcagttatcctgatgccatgtttccatctactcggaggaaactttcagtccacattcaaagcagatcgccctcaagactgggcccagagacattgctgggagtaagccagatgctgcaagggccagcctgcatcctgtgtggggcagtccctcctgacacgtggttcagcccctgctgcggatccacacgggaaccctcaggagcacagagggccccagtgctttgtcatcacatcccccaagtcagttccgccacagagaagacacacacagcagaagcccattcccagagcagacgccagtgtggcgctcatgcactgactctgtcagggacggatgctggccatctgggcacccatcgtggtgaaagcacctcctgggggctgtcctttcggatgttttgaaaccatctttattgacacatcagtcttcctaatgagaagccttcgctgcggtggccgcgtggcagggagggcctctggggaaggatccctcccaccacccctgcctctcctggcctttgtcagttcctctgccgacagcaccttggaaagagccgggtctgcttggcccacgagcaggtggtggccagatggttgctttggtgggacggcctttccctcctacagcttgggtctctccaccctcaggacctagcacgagcgcagccacctcccagctggtcccaggctctgccctctatcttggcatccagatttggagagcagtgccagctcaaggcaaaggccactatctctcttcagagcccttgcaccctcttggagatggcttgagcgagtggctccatctgacctaaaggacgcactggtcctgcagccccatctgcccacagcctgcctcctgtgtggcctctgcagtgagctctgcgcagtgggctcttctccaggcacctggaggcccactccccggctgtcccggaatcctcttctctgacctcggccctccgattttccccagaacgccatccatgaggccctgcccaacgtccctgcggttctcctgcctctctggctcctggcctctcgccaggcactcctctgccttgccccagccgtccacttgctccctcacttgtgcctgcaggaggccggcacagagcagaggactgcatggagtccacccctggggctccacctcctgtcctgtcctggattcacacttctccttctcctgcctcctgctgctgggccacagcaacaacagcaaaagttagctagattccgagatgcagagttcaattctgtagtcgttgaactcaaaatgaattgaacccactcttggtgcaccagccaaggccagcagggaggcaggttttccaggcggctgcagggctgcgaatttttgcatgtgactagagagctgggaaggggcccacccaggagtgttggtgtgtaaggaagatgcaaggttggatttgtaatgacaactcggcctttcttcagacatggccaagcccatcagcatgggcatggccagcccctgagcgggggacagtcctcccgctcagggtctgggtggtatattaactgaaaggggtccacagcaggctcacattgtttccttgatgaaggacaggctgcatctaccgaaggccatcagcactatgtgcctgtcatttctgagtaaaaaccaagtgatagcaatacagacgcccagggacacactggcatgtgcctgggctacagccggagcccccgtgctggctgcactgaccctggcgggctcgttgcaggccggctgcaggccctgtgtgctgccagcgggggccgaggagagcgaacgtcatggtccacaccacgtcgtttactcttagctctgcgtccccacgctgccattcacacagtgcgcatgcgacaagaggctccctttagtggtggtcaggaggtggaaggcccagttctgaagggtgtcctgggctgtcggacctgaggcagtaaaaccagaatagtcctgggaaaaccaaggcagttgttcaccctcccagaacggcccaacccttccagaggaagctgaccttgggctgctctggctaattaaacatttgcgggttctgtataaactgacacacactaagtgaatatatcggttactctttcaaaaacttaagccttcttaatactgcttgtgcttaaagaaccataaattccccacacagctaaattgtaagattctcacccttcccttttttcttaaccgaagtttttaggaaaatacttacaggcaccaacaagtacgaatgccttgaggctgtgtctcctgctctcccgcaagaatcaggtgttaaaaccttagaggcctattaaaaagcaagtaggtccggttgctagcccagggatgccaggggctgtttctgtgaaaacaggtggtattttccaattctcatgttcgtgtgagccttttgcagaaagtcaagccacagcatgctcatttgcctttgttccccacagtggatcatcccacaacttgtgactggcattctgagaagcacttctgattgcaagcagcgcttgtttgtggcctttatgagtctaaggctgttggcagctgagctcaatgcgaggaggctcgttaggaaatggcaccgctcactgtgtagccagccttggagacagacttgctatgctaatcaccttgcaaactagagcccctgatgctttactttggaactgatggaaatgctggatagggcttctttcagggactgggtggttatggtccgtccctggacaaaggacaaatctgtctggaaagtgttttaatttgccttctcttctgtcctgattgcagatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcaggcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgccggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaatgttgtatccattaaatattacaatccttctctcaggaaaaagctcccccgatggccccagacagtggaagcttcgggcctcaggaaacctagatgtgccctggaagagaccgaggatggcttagcctctgggcctgggaaccttgctactaaatacctaaaaactaagggtcctgtcaccaaggaggaagcaggaggacaagggcaggcatctggcagggcctgccaagatcaggttacatgcgtttcatatctgtgttttctctaagccaggcttgaccataagcctcacttgaattgttctgtctcttccctgatccctgaagctgaaggcctcgtcccaccagcatagcccacccactcttgctcgctccgttgcttcacaggctgctgtcccctcctccagccccacaggcccctctgggaggcatgagtgatgcggccaaggcgagcagcgccgtggccacccccaggacccccactgcagtggggtttccagcactccccatgcttccggctatgggacactagggcccctctcggggtcaggagggcgcctgagggagcagacaggaaatgctaagacactcctgaggagcctctcactggagcagccatggttggcagggtttcgtggtttgttcttcaccctgtcctgcctggtgtctaagtggtgggacaaggtgctaggacagaaatgggagctaggacagaaatgggagctagtccaggggatgggaggaagccgagttttctgttgaagtggagaagttacgaatggggtcttgacagggaagccagagaagaagggaccttggtgagcctggcagagtgaatccacccaaaatgctgggaagtcaaaaccgagcctggccttacgctgcccagaggacggcggatgcactggaggatttgcacagtgggagcaaatgtgaggaatgttctccttattcaacaaggaatccaaaatttttttgctttccaaggaagaagagaaacagttccccgtgcttctcccctcgcctttttcttcctctgtttccagcccaggaccacctcccccagcccgggggctcgggtgctaaagttcttccctctgccaaatgttgggaaatccgtagattttgtcgaaaaatcctaagtcattaatcatcgctaagccattttacaaccaaagaacaaaaattaagatacagtaagtacataacatgtcttcaagcctcctcctaaaatccagtttcacaattggtttataccatgggtccaaatcacacccctcaagcccaaactggtaatggagagctcatagcaaaggccttccctcccgctcctgtcatggtgtcttactgcacttgctgttctgggcagggaatttgttcacccaggacttttggttgcaagcaacagaaacgtgcactgaatgctgaaagtaaaggggaactgatgaaaaaggtattgggctgatgaggcctggtgtgagccggccagcagcagtcccagccttgcttcagatgctctggcaaggccagtcgtgctgcccagcccttccggaccccactccagccgggagaaaggcccttgtgcccactcctttccacacccctgcccaggtgcatcagatggaggagcctgggtcaaaggcctgccagggatgctaggaaatcacgcatctggcttcagcttctttaacgttattgggtaccttggataccaccaaaagcatcacccaactacaggaaggggccaaacactgggcaaatggagacaataaaaatgtctccagctcattacagcatctatactttagcctatgccagagcattttagaaggttgcgtcccatgaaacagcccagcagccagcaccagaacaggcagaggtgagccttttcagaaagatgttttgtaggcacctaaatctgggtttcttaaatgcagcaccatgagcactttggaccagatgcctccctgttgtgggggtgtcctgtgcactgcagggtg

SEQ ID NO: 11763 - DNA, 13880 bp, Human
tagcctgaccaacatggagaaaccctatctctactaaaaatacaaaatcagccgggcgtggtggcgcatgcctgtaatcccagctactccggagactcaggcaggtgaatcgcttgaatccaggaggtggagtttgcggtgagccgagatcgcgccattgcactccagcttgggcaataagagcgaaactccgtcaaaaaaaaaaaaaaaaaaaaaaaaagaaaaagaaaagaaaaagaaagataaaatgaaaattcgtggctgggcgcagtggctcactcctgtaatctcagcactttgggaggccgaggtgagtgagtcacctgaggacaggagttcaagaccagcctggccaacatggtgaaaccccttctctactaaaaattcaaaaaaattagcccagtgttgctgcacactcctgtagtcccagctactcgggaggctgaggcaggagaattgcttgaatctgggaggcggaggttgcagtgagccattgccctccagcctgggtgacagagtgagactctgtctcaaaaaaaaaaagaaaaaaaaagaaaatagaaaattatcgaggctatcattttaattttaagtctgctctcaaatgttaccttgtctgggaattccttccctgaactctacatatcccctatcaggcagaattgttttacccttctatgtgttccaacatcctctggcctccaacatattgggtaataatatatcatttatctttgttctattctgcttgattgtggactagaaggacctgggattttggcattcatctgtgcatgcacagtgataagggcagtgcctggcatggaacactaagttctttttggatgaacgtataagtgagaaagttctattccttaattccaatagcaccttgtttaggtccaccaattcctgaagacaccatgggaagatgacacctgagttaataaacttagatacaaaagctataccaatatgtcttttagtatactctgtttatgcaaatatcttagtttcctgcaaaaagattttctttttcaccccccacccccaccaaaaaaaccacacatgattagaggtgtgatttttagtatcttaaatattattgaaagccattcaaggttatgtttataattaaactgaaataaaagagattaaaaccttctctgaattttatctgtactgattttgctatggtctagctagttatggtatttcaatgatcacatggtttagccctaattctaatttaggcatactactcaatccaatgctgtttagatttgctcatgggatttgttataaagttcatgtctctcagtgttctcactatcccattcttgccactgtaaagatctaagcaccatcagtctaataatttagcagacaatggagtcttcttagcttttacacactatcaggtatggttcacagcagttagaatgcagcctgttgtatttccaagaccatctgctgcagcgaatcatgtaaacagtttccaaaagacggaaagagagagaaagatgatagatattaaagtcagagatggatctggagatttagagactaacacatactcactcacatacaacagcacttcagttttgggtctatgtgtgaaaccaagcatgccttaaacaaggaagacaagcttttcaaaggtgcaattggataacttctgccatagaaatggctgaattgggacacaagtggggacaattccagaagaagggcacatctctttcttttctgcagttctttctcaccttctcaactcctactaaaatgtctcattttcaggttctgtaaatcctgctagtctcaggcaaaattatgctccaggagtctcaaattttcttatttcatattagtctttatttagtagacttcttaatttttctattcatcacaagtaaaagcctgttgatcttaatcagccaagaaacttatctgtctggcaaatgacttatgtataaagagaatcatcaatgtcatgaggtaacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccaggtaggtacaaggtattatttttttctaccctcagtcacttagtggcaggggaagtcatagtcacggtgcttaggagatgaaactttattgatttaggcatggatccatctagtttaattaatatattgggtatgaggaagctacttgctgtactttccatgtggttctctctccctggagaggaacatttttactcagcttgcaaactggaaatagattttctcacattagaagctcattttctgggtatgagacaggagagttcatactgtgtatgtagatctctggcttctgggtctgacatgtgctgagggacacatatccttcacacatgcttttataaatacttgataaagtaacctgcttcttgattggtctttataatccataagctgtgggatgcttctctgaagatgaaaatagtaatagagtcccatctagctattcaaagccattccttcattgtattctgtgcacatgaagttggggtttgttactgacaaaatatattcagatacatttctatgttaaaaggattgtgagatgcataggtaaatgtgtttattttcagttttacttgtcaacatagatgaatgagaaagaacttgaaagtaacactggattaagaataggaaaatttggcatggattttgctccattttgtcccatctaatcacttggatagtgttcaggtgttcttggtcagttacttggatgctctgagctttagtttcttggtgattacaatgaagatttgaattacaggatggctttgaaaaaataaacaaaactcccctttctgtctgtcgagaatgttgcacagggagttacagaatgttctcatgactgaattgcttttaaatttcacagtgtgcctgcatttgaagtcttggaaatatctccccaggaagtatcttcaggcagactattgaagtcggcctcatccccaccactgcatacatggctgacagttttgaaaaaagagcaggagttcctgggggtgagtgagcctcctccaactttgactagagtaagggttgggtctagaaaagaatattgagttgcatcaactgttttcccacttggattcatgagaggtgttaggtcctttaaaaaacatggtagataaagagttgacactaactgggtccttttgggaagagagaagcatttcctcataaagactttaaattgctaggacgagaatggccaacaggagtgaaggattcataatctttatctttacttagatgtaaagaacaattactgatgttcaacatgactacgtacataaaggcgcatggagaaaagtattggccttccatgcattaggtagtgcttgtatcaattcttatagtggctagggtatcctggaaaatcttacgtgtggatcatttctcaggacagtctaggacactaacgcagtttctcatgtttggcttctattattaaaaaatgatacaatctcgggaaaatttttttgattttcatgaaattcatgtgtttttctataggtaacacaaattctgactgctatgatatgcctttgttttggaacagttgtctgctctgtacttgatatttcacacattgagggagacattttttcatcatttaaagcaggttatccattctggggagccatatttgtgagtatatatctataattgtttctgaaataacactgaacataggtttttctctttctcagatctaaccagttgtttattcccagtattaacatgatatttataattcttaattataaattatatgtgagcatatataacatagatatgctcattaacaacaacaaaagattctttttacaattaacggtgggttaaacatttagcccacagttttatcccatgagaaacctgaatctaatacaagttaaatgacttgcctaagggccacttgactaatagtaattgaacctaaactttcagaatccaactccaggaacatacttctagcactattcatcaataaagttatatgataaatacatacaactttatctgtcaactaaaaataacaacagaggctgggcatggtggctcacacccgtaatcccagcactttgggaggctgaggcaggtggatcacctgaggtcaggagtttgagaccagcctgaccaacatggtgaaacctcatctctactaaatataaaaaattagctgagtgtgatagtgcatgcctgtaatcccagctacttaagaggctgaggcaggaggcttgtttgaacctggaaggcagaggttgcagtgagctgagattgtgccattgcactccagcctgggcaataagagcgaaactctgtctcaaaataataataataataatagaaaataaagttgtcttcatgaaaaatgaggaaagagattgctggggtgagaaacattaagatcaaagggcatatggtgaccttctatgccctagaaactcttttaggtattttctcctggtatctcttttactcatcgttctatctggaaaaataggtggatgagtgagataataaggtatataactttttaaaggtctaattgacatataataaattgcaagtatttcagatgtacaatttgctaaccttgacacacatagacacacatgaaaacatcaccacattaatacaatgtatgtatccatcatttccaaaagcttccctgtgtatctttgtaactctttcttcctccctccactccttgtcctctcgttcccaagaaaacattgatctgctttctgtgaatataaattaacttacattttttagagctttatataagtatgttctctttactgtttgtcttccttcgctgcacagttattttgagattcttcaagttttttctttatatcgatacttcattcacaagaatatattttaattctagactatgtcacattgactttgtagtctgctaaatccttagtgctcagatgacttgttcaggactctccttgaacctgtacctctgttataattgaaacttgtctctactgtctttttatttcaaacacagcttatgaggtgtctctcaacccatcaaactcacaatctgagtctttaggagattgctttgaatttgtgctattgacttatatttatatcaaatatgtaaatgtttggtaaaaatatcatcatgtacattttcataattactctatattcacatgatatatgtcagactctggaaatatgcatgccacagacacgtgtttcttgcctaaaggggctgatggaagacgcacatacaaatagacgattgcaatagaatgagagtggtggtctaatcgattcatgccctgatgttgctggacgttgctactccaagagtaacccctgcattgtcagggttagcatctcctggaagcctcatgtaaatgaagaatttcatgctccatccaggacctaatgaataagaatctgcattttagcaagaccctcatatgattcatatacactttttttttttttttttagatggagtctcactcttgtcgcccaggctggagtgcaatggcatgatcttggctcactgcaacctctgcctcccgggttcaagtgattctcctgtctcagcctccctagtagctgggactacaggtgcatgccacagtggctggctaatttttgtatttttagtagagacagggtttcaccattttggtcaggctggtcttgaactcatgacctccggtgattcccccgcctcggcttcccaaagtgctgggattacagacatgagccaccacacccagccttattcgtatacacatttaattctgagaagcactctatagaaaataagaataagaaaatattgggctcacaggtgacattaataagtaactttatcgagtaccccaaatgttacctatgtttggaagatggggttaaaaaggacacattgaaaacaagaaactcattgtggcttttttttcctcctttttgaacagttttctatttctggaatgttgtcaattatatctgaaaggagaaatgcaacatatctggtgagttgcccgtttctgtctttgtccatccttgaaaagataagaagaacagagttttaagagtcttaagggaaacacatctttgtctcctatattacttgtgaatgtggatatatgattttgtttcaatctattttgtgtcctaaggctttttgcaacagaagttggatataatcattagaaacataaattgtaccatttaacatacaatgaagtttatgtttaccttgacgtttcttctaaaaaaagtgtcctcacaccggcattgtccttgtaggcatattcacatgatcaaataaataattagttttcaattaaggagaatatttgaggaaagaccgtacgtgttcatgtggttcctgaaggcagtccagtgagaaagtaatatatgctcattaaacaatgcggacattttcagggtttccctttttaaccaaaatttggaagcaatgtggaatttactggatgcatccagccctgaaatgaagataggtttattgaatgtgccagcaagtgcaggcccaggtctgagtgttcttcattattatcaggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgtatgtatttttttttgtgtgggaagactaagattctgggtcctaatgtaagtaagaagccctcttctcctgttccatgaacaccatccttttctgtaacttctattacacagtatagtggttctgtaagttcacacagcccagggagatgctggctgcccactcccctcaacccaggcaaattcctcggggttaaagttatctactgcaagtgacgatctctgggtttttctgtgcctgtgtttgtgtgtgtgtgtgtgtgtgtgtgtgtgtgtgtgtatgtgtcactttaaaaggactggtcagatggtagggagatgaaaacaggagatgctataagaaaataaacttttggggcgaataccatgtgactctttttgtttgtcatttgttgctgttcaataggaaattgtagtgatgatgctgtttctcaccattctgggacttggtagtgctgtgtcactcacaatctgtggagctggggaagaactcaaaggaaacaaggtagatagaagcccgatataaaatcttgaatgacaggttaacgaattggagctttattccttaaaaatatggcctgggttttctgaaacatttcttccagaaaatagtttctccaagttttattactttggtttacaaatctcacattttaaatcacattttatacccataagtagcacacatttcataatatatccctctgaatgagggttgggataataggatctgtataatgttagaaaatgccttaaagtgtgtggagcatgagagatggatgtgcagaaggcttgtgaggaaaccacccaggtatctggccttgttttctgccccagaagtagccgcctattcctgtttctgttttattcctttgtttcttgacttttcctttccaacttgctctaaaacctcagttttctttcctttctgattcatgactaccaaatgtttccacttgcctcacccgtccattacacctttgataagaaccaccagcaccttgtgctcatgtacttgcccatgtctgatggaagaaacatactctctccatctgtccactttcctgaggcattcaagtctagccaccttttaaaatcactctcctccaggctgggcacggtggctcacgcctgtaatctcagcactttgtgaggctgaggagggcggatcacttgaagtcaggagttcaaaaccagcctggccaaatggcaaaaccaaatcttcaattaaaaccaaatcttaaaccaaatctctactaaaaaatacaacaaaacaaaacaacaacaacaaaaacagaaaaggaaacattagcccagcgtggtggcaggtacctgaggttccagatacttgggaggctgaagcaggagaatcgcttgagcccaagagatggaggttgcagtgagccgagatcatgccactgcaccacagccagggtgacagagccatacttcccagcacattgggaggccaaagctgaagaataatttgaggtgaggatttggagaccagcctggccaacatggtgaaactccgtctgtactaaaaatataaaacttagtggggcatgggggcacacacctgtaatttcagctacttaggaggctgaggcaggagaattgcttgaacccgggaggcggaagttgcagtgagccaagatcgtggccactgcactccagcctgggtgacatagtgagattctgtctcaaaaaaaataaaagaaatttaaaaaatcactctcttccaaagatagataaataagacagcagatatactaaggaataacctcaccaacttgtcattgactgacatgatttcttttgggcccacttggccagctagtctggtttggttttctggaaatgaaagaaataatcagagtttaatgacagagagcgtgagacccagaaagacaaaagtagatgaggtaagtctcttgagcgagacttctagggatgggaaatttgtggtgattgatatgaaatgatttttcccttatcaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggtcttgttaaggggctactggaaaaatttctattctctccacagcctgctggttttacattagatttattcgcctgataagaatattttgtttctgctgcttctgtccaccttaatattctccttctatttgtagatatgatagactcctatttttcttgttttatattatgaccacacacatctctgctggaaagtcaacatgtagtaagcaagatttaactgtttgattataactgtgcaaatacagaaaaaaagaaggctggctgaaagttgagttaaactttgacagtttgataatatttggttcttagggtttttttttttttttagcattcttaatagttacagttgggcatgatttgtaccatccacccatacccacacagtcacagtcacacacacatatgtattacttacactatatataacttcctatgcaaatattttaccaccagtcaataatacatttttgccaagacatgaagttttataaagatctgtataattgcctgaatcaccagcacattcactgacatgatattatttgcagattgacaagtaggaagtggggaattttattaagttactcgttgtctggggaggtaaataggttaaaaacagggaaattataagtgcagagattaacatttcacaaatgtttagtgaaacatttgtgaaaaaagaagactaaattaagacctgagctgaaataaagtgagtggaaatggaaataatggttatatctaaaacatgtagaaaaagagtaactggtagattttgttaacaaattaaagaataaagttagacaagcaactggttgactaatacattaagcgtttgagtctaagatgaaaggagaacactggttatgttgatagaatgataaaaagggtcgggcgcggaggctcacgcctgtaatcccagccctttgggaggccgaggtgggcagatcacgaagtcagtagtttgagaccagcctggccaacatagtgaaaccccgtctctactaaaaatacaaaaaaaaaattagctgggtgtggtggcagtcacctgtagtcccagctacttgggaggctgaggcaggagaatcgcttcaacctgggaggcggaggttgcagtgagccgagatcgcaccagtgcactccagccttggtgacaatgggagactccatctcaaaaaaaaaaaaaaaaaaaaaaagataaaaagtcagaaatctgaaaagtggaggaagagtacaaatagacctaaattaagctcatttttaggctttgattttggggagacaaagggaaatgcagccatagagggcctgatgacatccaatacagagttctggtaaagataaaatttgatacaggtttggtgtcattataagagaaatcattattaaatgaagcaagttaacactctaagagaattattttgagatagaagtgaagctaagctaaacttcacatgcctataattggagggaaaaactaaggataaaatctagcctagaagatacaataattagtcataaacatgcattgtgaaactgtagagagcaggtagcccaaaatagagaaagattagataaagagaaaataagtatccatcagagacagtatctctaggcttgggcaagagaaaagtccacagtgataagcaactccacctaaggcatgaatatgcggcagagaaaacagcaatagtgaatgaatgcaaaaggtgctgagaaattccacacatgagtattgtgatgagtaaatgaataaaacatttgcaaagacctttagagaaagagaatgggagcatatgtgagaaataagatagttgattatgaatagaaggtagtgaagaaaagcaagctaagaaaaaattctgtttataaaagaaggaaaagatagtttatgtttttagcctaagtataagagtcctacagatggactgaaaaaaatcagtctgagagtattagtcacaattaatgaaataattacattttatgtattgaggatgccaagattaaaaggtgacaggtagatgttaatttccctagattgtgaaagtgatcacgacaatcacacaacaaataattaagtgacttggtatgctttatttaattgtagggcctgaggttttccattctcatttttctaaaatacaattttgtttctccaaatttgacagcagaataaaaaccctaccctttcactgtgtatcatgctaagctgcatctctactcttgatcatctgtaggtattaatcacatcacttccatggcatggatgttcacatacagactcttaaccctggtttaccaggacctctaggagtggatccaatctatatctttacagttgtatagtatatgatatctcttttatttcactcaatttatattttcatcattgactacatatttcttatacacaacacacaatttatgaattttttctcaagatcattctgagagttgccccaccctacctgccttttatagtatgcccacctcaggcagacacagagcacaatgctggggttctcttcacactatcactgccccaaattgtctttctaaatttcaacttcaatgtcatcttctccatgaagaccactgaatgaacaccttttcatccagccttaatttcttgctccataactactctatcccacgatgcagtattgtatcattaattattagtgtgcttgtgacctccttatgtattctcaattacctgtatttgtgcaataaattggaataatgtaacttgatttcttatctgtgtttgtgttggcatgcaagatttaggtacttatcaaagataatggggaattaaggcatcaataaaatgatgccaaagaccaagagcagtttctgaagtcctccttttcatcagctctttatcaaacagaacactctataaacaacccatagccagaaaacaggatgtaggaacaatcaccagcacactctataaacaacccatagccagaaaacagaatgtagggacaatcaccagccatcttttgtcaataattgatggaatagagttgaaaggaaactggagcatgagtcatatttgaccagtcagtcctcactcttatttacttgctatgtaaacttgagaaagttttttctccttgtgaacctcaggttttacatctgaaaatgagaaatttggaacaaaagattcctaactggtctttctgttcccatattctgtgatttttcaatatttaggatttttggtaatcacaattacttagtttgtggttgagatagcaacagcaatcagaactatttggtggacatattttcaaaggagtagctctccactttgggtaaagaagtgatgccggtcgtggtggctcacgcctgtaatcccagcactttgggaggccaaggcgggtggatcacgaggtcaggagatcgagaccatcctggctaacacggtgaaaccccgtctctactaaaaaatacaaaaaattagccaggcgtggtggcgggcgcctgtagtcccagctactcgggaggctgaggcaggagaatggcatgaaccagggaggcggagcttgccgtgagccgagatagcgccactgcagtccctcctgggcaaaagagcaagactgcgtctcaaaaaaaaaaaaaaaaaaaaaaaaaaagaagtgtgtggtgtagcaggacacctgcaacaataatatttttctaaatccctctgaaaaatgctaatcaaagggtttttttcctaaaaattgtcttagaaataaaatttcccctttgggagaccgaggctggcagatcacgaggtcaggagatagagaccacggtgaaaccccgtctctactaaaaatactaaaaattagccgggcgtggtggtgggcacctgtagtcccagctacttgggaggctgaggctggagaatcacgtgaacccgggagcttgcagtgagccgagattgcgccactgcactccatcctgggtgacacagcgagactctgtctcaaaaaaaataaaaaataaaaaaagaaagaaaatttcccaaataattcccattataagtatataataggtaacaattcccgctatagacatgaatctacttatataaacaactaatgagacagggtaccatatttttaattgtaacttgatttagagtgttggggtaaatctatatatcccagagtgtgaggctccctcgttagtatctctctgtgttacatgagtatttccctccactggaaaacctctgttcactctacaaacagttaagtgagctgaacttacatctccaaatagcctctatctgggagttccagcatagggttttgttgaacaatattgggggtcatggattattaagatggtggattttggaatacaatatacgcagaagcaaattgcagtagctatattaggtattggctgtatgatcttggccaatcattttattctatcttagttttcttctgtttcttaaatggatatattaaacataatattgtgcatgttcaaaaatcatttagcccggtttctcgaatgatgaatggaacctgttttttcatttatagacattgatgtgtaatcctgaacttgaaattaggaaaagagacactgtcagcttctcaggaacgtttggcaatattcacctatcccttaactccggttggaaaaagtgggcttaagaccctgggtaagatcagggaatgtaattattagtaaccttcacatagactacttccaaataaattgaactgtaaaaaacatatattacaaaatgatgttatcttagtcccaaaaaggcagagaggtagatggaaagaggctctagggaaaatgctatcagat

SEQ ID NO: 11764 - DNA, 16573 bp, Human
  misc_feature (1)...(16573): n = A,T,C or G
ggaatgctgtcaacttttgccacagattcattagctctgagtttcttttttctgtccccagctaccccttacatgtcaatatggacttaatgatgggaaattcaggcaagtttttaaacattttattccccctggctcttatcctcaaaaaatgcatgaatttggaggcagtggctcatgcctgtaatcccaatgctttgctaggttgaggcgggaggatcacttgaagccaggaatttgagaccagcctgggccgcatagtgagaccccgtttctacaaaaataaataaataaataataaataatagtgatatgaagcatgattaaatagccctattttttaaaatgcatgagttcgttacctgattcattccctggttcctttcacagtcctccgtgacccaagtgttagggttttggtctctctactatttgtaggctgatatatagtatacacacacacacacacacacatatacacacacacagtgtatcttgagctttcttttgtatatctacacacatatgtataagaaagctcaagatatagaagccctttttcaaaaataactgaaagtttcaaactctttaagtctccagttaccattttgctggtattcttatttggaaccatacattcatcatattgttgcacagtaagactatacattcattattttgcttaaacgtatgagttaaaacacttggccaggcatggtggttcacacctgtaatcccagagctttgggaagccaagactggcagatctcttgagctcaggaattcaagaccagcctgggcaacatggaaaaaccccatctctacaaaagatagaaaaattagccaggcatggtggcgtgtgcctgtggtcccagctactcaggaggctgaggtgggaggatcacattagcccaggaggttgaggctgcagtgagccgtgattatgccactgcactccagcctgggagacagagtgagaccctgtttcaaaaaaaagagagagaaaatttaaaaaagaaaacaacaccaagggctgtaactttaaggtcattaaatgaattaatcactgcattcaaaaacgattactttctggccctaagagacatgaggccaataccaggaagggggttgatctcccaaaccagaggcagaccctagactctaatacagttaaggaaagaccagcaagatgatagtccccaatacaatagaagttactatattttatttgttgtttttcttttgttttgttttgttttgttttgttttgttttagagactggggtcttgctcgattgcccaggctgtagtgcagcggtgggacaatagctcactgcagactccaactcctgggctcaagcaatcctcctgcctcagcctcctgaatagctgggactacaagggtacaccatcacacacaccaaaacaattttttaaatttttgtgtagaaacgagggtcttgctttgttgcccaggctggtctccaactcctggcttcaagggatcctcccacctcagcctcccaaattgctgggattacaggtgtgagccaccacaaccagccagaactttactaattttaaaattaagaacttaaaacttgaatagctagagcaccaagatttttctttgtccccaaataagtgcagttgcaggcatagaaaatctgacatctttgcaagaatcatcgtggatgtagactctgtcctgtgtctctggcctggtttcggggaccaggagggcagacccttgcactgccaagaagcatgccaaagttaatcattggccctgctgagtacatggccgatcaggctgtttttgtgtgcctgtttttctattttacgtaaatcaccctgaacatgtttgcatcaacctactggtgatgcacctttgatcaatacattttagacaaacgtggtttttgagtccaaagatcagggctgggttgacctgaatactggatacagggcatataaaacaggggcaaggcacagactcatagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggtaagaaccatatagagaggagatcagcaagaaaagaggctggcattcgctctcgcaatgtctgtccatcagaagttgctttccccaggctattcaggaagccacgggctactcatgcttccaacccctctctctgactttggatcatctacataaagggggaagacagaaaaaatcctaccagtgagttgaaaatacaggaaagcctatttcatatgggttaaagggtaggacagttgaatttcgtgaaaagtctgagttatataggctttgagcaaagagttttattagtatgaagcagaagaggtaacataaagaaagatgtatggggccaggcatggtggctcacacctgtaatcccagcactttgggaggccgaggtgggcgaatcactcctgggtgaactcaggagttcaagaccagcctgggcaacatggcgaaactccatctctacaaaaacattacgaaaattagctgggcgtgttggtgctgtagtcccagctactcaggaggctgaggtgagaggcggaggaggttgcagtgagtcaagatcatgccactgcactccagcctgggcaacagagtaagaccctgtctcaaaaaaaaaaaaaagatagatgatgtatgctgtatgaaaaaaggaaacacacagatgattcaacagcctgttttgtggggtaatgaaaagtcaccctgggaactgggctccagccctcgttctgccacccaccaactacatgtccttggcaagtcatatcaattatctgagtttctgttttataatctacaaataggttatctctggcagcttaataataatcagggttaacatttattaaacagtgtgtgccagtccatgtgctatgtgcttttctgtgaggtagttactgctatttacagaaacagtagatgcagagaccaaggtgctgagttaaatgattaggccaacaaggttagtacatgccgagccaggatggaagcccaggtaggcaggctggcttccgcggcaatgctcttatgaactatgttacgtccagtgctgataaactgactctctggggagcaggggaaagccctgagtttagcatttgccaatttctatcacgtaaacattcccattctggccactttctttctttctttcttttgtttgtttgtttgagatggagtctcgcactgttgcctggctggagtgcaatggtgcaatctcagctcactgcaacctctgcctctccggttcaagtgattctcctgcctcagcctcccaagtagctgggattacaggtgcccgccaccatgcccagctaattttttttgtatttttagtagagacatggtttcactatgttgactaggctggtctcgaactcctgacctcatgatctgcctgccttggcctccctaagtgctaggattacaggcgtgagccactacacccagccgcatgattctaaaaaataaaaagatgaagtgttattccaaacatctgatctccattgaagaaccatgcaatctctctgggttgatagaggccagagttagtggctctccctgatttcggtgagaaatcactattccaccatcacgggataaaaggcatcctgactggcggttgacacctatttccacagtgaaagatatatctagtacttttaaaggggaagtggtttgtctgagatactctgtttcaaagtagagaggatacagaacaagcatctgaagctatatacatccttacagagagcaattctgatggaaatgcaggccatgtttccctggggggggctcgtcctaggggctggagtgcattctctgatgtcagaggaaatgcaagattccctgaggcctgagggaacccatggtatatgcaagtccaagtttcaaactgtagttccatatgcattcttccaggacaaatacttcttgaggttaaaaaaaaaaagtcacatagctgccattttatggatttcaggatttttttttttttttttttgagatggagtcttgctctgtcacccagcctgtagtgcagtggcataatctcggctcacggcaacctccgcctcccaggttcaagcgattctcttgccttagcctcccgagtagctgggattacagtcacgcaccaccacatctggctaattctttatattttttggtagaaacggtgtttcaccatgttggccaggctggtctcaaactcctgacctcatgtgatctgcctgccttggcctcccaaagtgctgagattacaggtgtgagccaccgcgcctgcctggagttcagaatcttgggcttcattatttgtgtttaaatagatcatacagtcaggcacgnnnnnnnnnnnnnnnnnnnnnnnnnnnnnnnaggtgggaggattgcctgagttcaggagatggagaccagcctgggcaacatggtgaaaccccgtctctactaaaaatacaaaaactagctggatgtggtggcacacacctgtagtcccagctattcaggaggctgaggtgggaggatcccaggaggtagaggtcacaatgagccgagattgcgccactgcactccaggctgggttactgagccagatcctgtctcaaaaaaaaaaaagataatacattcaaacagttcaaaatgcaaaagttacatacataaggaagtgtcatgaaatatctccctctcacacttctccccagccacccagttctcccttctagaggcaacatgtgaaatccttctcaggctacactcttcttgaaggtgtaggctttgggcaaaagcattcattcagtaaccccagaaacttgttctgtttttccataggattctctttggacagcgtccatactggtgggttttggatactgactactacagcaacacttccgtgcccctgataaagcagttccctgtaacctgtgagactggaccaggtaagcgtcccagcccctgcagacagaagctgagtggacctcgtttacctgttatggatgaaactgaccttgaggggacatgaggagagccattcctttgtacttttgtcatgctcttcaattggcacaaattaattcacttctgcaatactttcctgaatagcacagtagtattggaaatctgcctattacagaacctggatggagtccagagaggcacgggcatccatgggcaaagggctcgtgagagtcaccgccctgcagcgctgtgtcctgagaaaggagggggcagaagcctgagcttctgggggtccttcccaatggcctggcccactggatgtgccctcctgagctgaccgtccaatcccttgccctctctgtgcctacgttttattagttacagccagatggttactgtcaaatcaaatgatagatttcattttcagtatgtaataggaagcccctccctcaccctaaagtctcagctgccctctaagactagtactctctaaggtactagtatcccttcctcagagaccctttccctgaccccaaaactagggaaggtcccttagttatttgctctcacagaccacgcatttacctcagagcatattcactcattcagctgttacttaccaagcacctactgggagctatacactgttctatgtgctagggatacctctgtcagtgaacaacacagacacaaagatccctgcccttgtggagctgaaatctgaatagaggaggtgaaatatacaaaaattataataaataagtaaactaggccagttgtggttgctcatgcctgtaatcccagcactttgggaagccaaggtaggtagatcacctgaggtcaggagttcaaaaccagcctggccaacattgcaaaatcctgtctttactaaaaatggaaaaattggtcaggcgtgatggcacacgcctgtagtctcagctacctgggaggctgaggcaggagaatcgcttgaacctgggaggcagaggttgcagtgaaccgagatcggaccactgcactccagcctgaatgacagaacgagactctgtctcaaaaaaaaagtaaactattaatatgtaggataggccaggcacggtggctcaccctgtaatcccagcactttgggaggctgaggcgggtggatcacctgaggtgaggagttcaagaccagcctggccaacatggcaaaaccctgtctctactaaaaatacaaaaattagctgggtgtcctggtgcatgcctgtaatctgagctactcaggaggctaaggcaggagaatcgcttgaacctgggaggtggtgagccaagattgcgccattgcactccagcctgggcgacaaaatgagacaccatctgaaaaaaaaaaaaaaaaatatatatatatacacacacacacacacacacacacacacacacacacacacatataatactagaaaatgattgtttataggcaaaaaaaaaaaaaaagaagaagaagaagaaaaggaaaggagaaggaaagaaggaccaaacatcttttgtagaaatatgtttgctttcatcataacagcttgttatcaaggatgaatttctccctgaaattaatggaggcacagactggaaagtttaaagtggctttaagaggttattttatttagtcctctgtcttaatagaagcaaattattatctctgctccttaggtagagtagctaaggctcagaaagtaggccgggcgcggtggctcacgcctgtaatcctagcactttgggaggccaacgcaggtggatcacctgaggtcaggagtttgagaccagcctggccaacatggtgaaacctcgtcactaataaaaaaatacaaaaacttagccaggcatggtggcgggcgcctgtaatcccagctacccaggaggctgcggcaggagaatcacttcaacccgggaggcagaggttgcagtgagctgaaatcacaccactgcactccagccttggtgacagagaaagattctgtcaggaaaaaaaaaaaaaagtttaaatgaattacccaaggtatataattgttagtgttagaaggaagaagaagggagggaggaaggaagggagaaagaaagggaaggaggaagggagggagggaagaaagcctttatttatctatggggttccctggaaagcaggctgaaatggagattcacgtgcaggagtttagatactctggggaactatacttgtagaagggaaggaacaggaacagggcagaaggagaggtccggttgtgattctgcctcatccaaccccacagcgagctctgaagctggggatggctcctcagagttggtccaagttgggacaagggaatcagaccctggggagagcgtaaccttgatcaaggcgactctctttagcccagggcaatgccaggagaaggctgagagcagaaagccatctaccatcacactctcaacagctacgaaataagtcctgcagttcaggagggaggtctgggcggcacatctcaggaccctctatctctcagggtagaggaattaagaatgggatgggaaccagacgggccatggtggctcacacctataatcccaacactttgggaggccaagggtaggaggattgcttgagcccaagagttcaaaaccagcctgggcaaaaacaatcaaacaaacaaacaaaacacatttaaaaaatttgctgtgtgtggtggtgtgcacctgtggtcccagctactcagggggctgaggtgggaggattgcttgagtccaggaggtcgaggctgcagtgagctatgatcatggcactgcattgcagcctaggagacaaagcaagacactgtctctaaaaaaacaaaaaacaaacaaataaaaaaacggaaccggttgcaagcagggttaaatagcgtggtcagagtaggactcactgagaatatgagatctgagtcaagtcttcaaggatgtgaggaagtaagtttctggcagaagagctgtgaagggctgtctggccagagaagattgcaatgcaaaagccctgaggtgggaacgtgtttggtgtgtttaaaggaaagcaatgaggccagtgtagccagaacagagtgtgcaaggagagaaggaacagaagatgtggagggcagatcagtttgtaattgtacgcccagtatgctgattctttgtgtaatctccagactgtattaaactgcaagagcagggcccctctctggctttgctcaccattgtattcccagagccttgcacaatgcttggtgcataggagatggaaatttgttaaataaatgaattatggataacgaatggatggtaagatgggtggatggatggggggtgaacggatggatggggggtgaatggatggatgaatgggtagatgggtggatagggggatggctgggtggctgggtagatgatgcactgtctcccagatgaggaccttttcacctttactccattctctttcctgccctttagggagcccctctggccatgccatgggcacagcaggtgtatactacgtgatggtcacatctactctttccatctttcagggaaagataaagccgacctacagatttcggtaagaactcaccactggggtgtaggtggtggagggcaggaggcagctctctctgtagctgacacaccacgtattcttcctcacatccccctagcccgctcccacacctgggcagccgctgattaagagttgtggcactttggatagggataaacctcagagtcagggaatgtttgggctgaaagggatccagtagtgcaatccgttgttttacagataaggaaacaaagcccaacaccatgaagggacttataaaaataaggtagtgaagtagcagcagggcttaaataaaaacccatgtctgtaccaaccacagagtcacccatccaggttaaaataaccagagaaacagaagatattcctactacagagaattccgggtgtgcagccacagtgcaaatcctttttatttttatttttgagatgcagtctcgctctgtcatccaggctgaagtgcagtggcacgatcatgtctcgctgcaacctctgcctcccaggctcaagcgatcctcccacctcagccatctgagtagctgggaccacaggccacacaccacacccagctaatttctcgtatctttttgtagagacagagttctgctatgttgcccaggctcaggctggtcttgatctcaagcaattggcttgcctcagcctcctaaaatattgggattacaggcatgagccaccgcgccagccatgcaaatccttaattatcaaacagataaaatagggaagttaaaattcatatacacaagggttaaccacttgccacaggcattttttttttttttttgagacggaatctcgctctgttgcccaggctggagtgcagtggcgccatctcgcctcactgcaacctccgcttcctgggttcaagctattcttctgcctcagcctaccgagtagctgggactacaggcacgtgccaccacacctggctaatttttttatttttagtagagatggggtttcaccatattggccaggctggtcttgaactcctgacctagtgatccatccgcctcagcctcccaaagtgctgggattgcaggcatgagccaccgcgcctggccttttttttttttttttgagacggagttttgctcttgttgcccaggctagagtgcagtggcgcagtctcggctcactgtaacctccacctcctgagttcaagcaattctcctgcctcagcctctcaaatagctgggattacaggcgtgagccaccccacctggctaattttgtaattttttttttagtagagatggggtttcacctgttgatcaggctggtctcaaactcctgacctcaagtgatccacccacctcggcctcccaaagtgctgggattacaagcataagccaccgtgcctggtcaattttgatcttttttaaagagacaggggtcttgctatgttgcccagactagtcttgaactcctggcctcaagtgatcctctcacctcggcctcccaaagtattgggattacaggtctgagccgctgcacccagcccccaacaggcatctttggacttttgagtactggctttaatttacaaaaattccactgagagcacctaagtttgccaggctccaacatttctgcaggggctgttttctttgctgaaggatctgcacctgtgttctgttatggttgcctcttctgttgcaggtgcttgaatgtcattttgtggttgggattctgggctgtgcagctgaatgtctgtctgtcacgaatctaccttgctgctcattttcctcatcaagttgttgctggagtcctgtcaggtatgggctgatctgactcccttccttctcccccaaaccccattccgtttctctccctaatcaggacaaaatcccagcattccagccacatcctgtgtgtaatcagtactgttagcatttctgtgggttgaaagtcaagaatgagcaacttgaaatgattaatttctataagagtgcccagatctatagaatgaattgtgtagaagttaccatacatcaaattaacgcaccaaattgaattagcttgaaatctcagagctttttacaatctttatttcttactggtcttcaacaggccctaatttacttttcagggaatctgccaaatttaacaaattaacacgatgtcctaggaaagctgttcatttaaatacattcatttgcaaacctaatagataactgcagttgatctcttttataggttcagagttttgaatatgtttttttttgttttttttttttgagatggagtctcgctctgtgacccaggctagagtgcagtggtgcgatctcggctcactgcaagctccacctcctgggttcacgccattctcctgcctcagcctctccgagtagctgggactacaggcgcccgccaccatgcccggctaattttttgtatttttagcagagacggggtttcaccgtggtcttgatctcctgacctcgtgatccgcccgcctcggcctcccaaagcgctgggattacaagggtgagccaccgcaccctgcctgaatatgtgttttcttagatccaattaacaagggtaagacaagatttaagttaagcataagaaagattttgtgggaggcactggaatataagaccttaacaaaactgtggaatttctcccctggagatttgtaagaacggaacatagcagcattcaaagaagaatgttgagaacaagggagataatggtttcatggtaatcacaaaagtaacacagcatttagtactgggttccatgtttgaggaagaacctggaagccatatcacatgaaaaacctgggaatgtttaggttagagagaataactgtgttcaaatgtgtgacagagggactagattcatcacttactaactcctgcagaaagaactgagaaaaatagacagtattagagggggaccagtttcacacagacaaggaagaactattcagcaatcaattccgttcaaagataaaatggactgttatagtgggggtgagctccctacctctgagggtatttcaagtagagataggaggacctcctggtaggaaatttgcatacggtgggagattgtacgtgatatggcacctccatctgaaagagtctatattgagggcaggctggagtcacacatgggaataagccaggcgaccctcccatctgccatctgtgatttaattccacagtcgcagaacggatggcatgtcacccactcctccaaacccacctctagcaaaggtcccaaatccttcctatctctcacagtcatgctttcttccactcaggcattgctgttgcagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcccattttgaggccagaggtgctgtcagctcaggtggtcctcttttacaatcctaatcatattgggtaatgtttttgaaaagctaatgaagctattgagaaagacctgttgctagaagttgggttgttctggattttcccctgaagacttacttattcttccgtcacatatacaaaagcaagacttccaggtagggccagctcacaagcccaggctggagatcctaactgagaattttctacctgtgttcattcttaccgagaaaaggagaaaggagctctgaatctgataggaaaagaaggctgcctaaggaggagtttttagtatgtggcgtatcatgcaagtgctatgccaagccatgtctaaatggctttaattatatagtaatgcactctcagtaatgggggaccagcttaagtataattaatagatggttagtggggtaattctgcttctagtattttttttactgtgcatacatgttcatcgtatttccttggatttctgaatggctgcagtgacccagatattgcactaggtcaaaacattcaggtatagctgacatctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacatcttctctctttttttttttttttgagacagggtctcactatgttgcccaggctgctcttgaattcctgggctcaagcagtcctcccaccataccacagcgtcccgcgtagctgggactacaggtgcaagccactatgtccagctagccaactcctccttgcctgcttttctttttttttctttttttgagacggcgcacctatcacccaggctggagtggagtggcacgatcttggctcactgcaacctcttcctcctggttcaagcgattctcatgtctcagcctcctcagtagctaggactaccggcgtgcaccaccatgccaggctaatttttatatttttagaattttagaagagatgggatttcatcatgttggccaggctggtctcgaactcctgacctcaagtgatccacctgccttggcctcccaaggtgctaggattacaggcatgagccaccgcaccgggccctccttgcctgtttttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatctgaagtttctaattctggcccaactaaatttctagctctgtttccctaaacaaataatttggtttctctgtgcctgcattttccctttggagaagaaaagtgctctctcttgagttgaccgagagtcccattagggatagggagacttaaatgcatccacaggggcacaggcagagttgagcacataaacggaggcccaaaatcagcatagaaccagaaagattcagagttggccaagaatgaacattggctaccagaccacaagtcagcatgagttgctctatggcatcaaattgcaacttgagagtagatgggcagggtcactatcaaattaagcaatcagggcacacaagttgcagtaacacaacaagactaggccagctctggaatccagtaactcagtgtcagcaaggttttgggttatagttcaagaaagtctaaacagagccagtcacagcaccaaggaatgctcaagggagctattgcaggtttctctgctaagagatttatttcatcctgggtgcagggttcgacctccaaaggcctcaaatcatcaccgtatcaatggatttcctgagggtaagctccgctatttcacacctgaactccggagtctgtatattcagggaagattgcattctcctactggatttgggctctcagagggcgttgtgggaaccaggcccctcacagaatcaaatggtcccaaccagggagaaagaaaatagtcttttttttttttttaatagagatgggggtctcactatgctgcccaggctggtcttgaactcctgggttcaagtgatcctcctgcctcagcctcccaaagtgctgggattacagtgtgagccactgcgcttggccagaaatggttttgatctgtctgaactgaaccctactgcttaggcatagccccatccttgataatctatttgctcccaaggaccaagtccaagatccttacaagaaaggtctgccagaaagtaaatactgcccccactccctgaagtttatgaggttgataagaaaacataacagataaagtttattgagtgctaactttatgccagattctgttctatgtactttatttatacaattaactcgcttagttctcccaacatctctgtgagttggctactgtcatttatccttatattacaaataggtccagaggggttagtcatcttgtccagaatggtggaaccaggttaaggatcaggcagtctgggctgggcatggtggctcacatctgtaatcccagcactttgggaggctgaggtggcagattgcctgagctcaggagttcgagaccagcctgggcaacatggtgagacccccgtctataccaaaaatacaaaacattagccaagcgtggtggtgcatgcctgtggtcctaactactcaggtggctgaggtgggagaatcccttgagctcagaggttgcagtgagccaagattatgccactgcactccagcctgggtgacagagtgagaccctgtctcagaaaaaaaaaaaaaaaagaagcaagcagtctgggctgggtgctgtggctcgcgcctgtaatcccagatacaaaataatcattttgtaatatatcctgcttattagacagaacattttgatcactcatctgttccctaagttatagatttacgtccactttagaaatggcttgtgaggcaagtttaagtgaccgatgacagttttaaagcaaggtccatgtcatgttatggcataatttggtagaatgttctagtagtgtatcagttttcaggtggtaggcttgaggatgatacacacacacacacacgcaatgcaattctattattgcccaaagaaaatagacccattaaggaagtccaacttctgctgcgtggaccagtgctgccacatcacacatagaccaaaggcttaggtttttgtggttttggttatttattttatctttttattttattttatcttattttattttattttattttattatttgaga

SEQ ID NO: 11765 - DNA, 22404 bp, Human
  misc_feature (1)...(22404): n = A,T,C or G
tttcttctggtttgcatagccctatatggagtctcttttcctacccagaacctttcagagatcgtggccctgcagacacgccttaagcacctgcaggctgtgaaggaggggcgctacgtgttcctgttccgctccaagcagtccctagtgctggagcgccagcgcctggacaagcgactggctctcatcgccaccatcctggaccgcgtgcgggacgagtacccccagttccaggaggccctgcacaaggtcagccagatgatcgccaacaagctcgagtcaccagggccctcctagggagcagcctggactccgccttgcaaggcctccaggaagagatccggaattgtgtttgtcatgagggacttggaatcttttgtgttcctaaaaaccacatgtaccctcagaagggcatcgtttaagagaaataagccagccccacccataggaatctttttagccactcagcaatttaataaaccaggtaaaatcctagcgtttcccatggcatcccatcgcaaagacagagcctgtgactgcagacccacacacccacactcccacactgggcttactcgtccaggtaacactttggtttgcagcactcccaaatctgcacgtgcctctcacaacacaacgctgccacaggtccacaagctggtgggctgagcagaggtgggaaagttaaggcagctccagccagcctggcccgggaggctggtccccccagcacttccctctactaggtgcatctgaaaacccacaaaccaccttctttaccagttttcccatccccaccccttagaactctcaggtcccttttcctgcccccatgtccccatttgagttaaattcagatccacagcttgcaggagaaagtcagtggccccagacacacgtaacagggtgagcactgaaataagagcacgctggggcgtccacaccaagggactacgccccagtctgcccacctatcttttctccatcattaacccagcgctctttctccctggacttccaagtaccaatgaccttggggcttctttgcagtttaaagggaaaatgctctacaaaataatttcactttcaaacatttcagcagaagaataaaatcttttttctgaatatctagtaagcctttctgagtcagccttacttattttaaaacattgtagaaatacagaaaccacaacagaggtggaagggaggcttttgtttttttttttttgagacggagtctcgctctgtcgcccaggctggagtgcagtggcgcggtctcggctcgctgcaagctggaaagggggcttttaatgcccctatgcccctacccaggaacaacacctctgtgttttggtgtggctccttttgtatttttctgcacatacattttattaagttaaggttatactgtgtgttttttgtatctcacatgtaaaaatgtgctcctcttaatgtaagcattttctcattttatgaaaaaattccccctgtgtcagtttaatgttttctcaattgtcagttttatgggttatcacaatgttttgattattcctttctggaataactgtgagttatggagcacacttaaggactttccaaatgttggctgtttctaacttggcgctgagcgcctttggccgcctttccgatgatgccctcgggacgcgttggcaggaggaatccctgggcgcaaggcgcggctgggccagccccttacaaagccctacgagctgcggggacccaggccggggcagcgggggccacgccccatctccgaccccacggggaccgggccgggactgcgccagcgggggcctcgccccgtctctgaccccagaggaaccggcagcgggcagcacgcgtgggcctctccccgcgggacgccggacgcgcagccagacgcgctccccaggccccctccgagagcgaggacgcgcccaggcccgctctgccggagccgccactggggggcgtagcgcggacgcgcacccttgcctcgggcgcctgcgcgggaggccgcgtcacgtgacccaccgcggacccgccccgcgacgagctcccgccggtcacgtgacccgcctctgcgcgcccccgggcacgaccccggagtctccgcgggcggccagggcgcgcgtgcgcggaggtgagccgggccggggctgcggggcttccctgagcgcgggccgggtcggtggggcggtcggctgcccgcgcggcctctcagttgggaaagctgaggttgtcgccggggccgcgggtggaggtcggggatgaggcagcaggtaggacagtgacctcggtgacgcgaaggaccccggccacctctaggttctcctcgtccgcccgttgttcagcgagggaggctctgcgcgtgccgcagctgacggggaaactgaggcacggagcgggtgagacacctgacgtctgccccgcgctgccggcggtaacatcccagaagcgggtttgaacgtgcctagccgtgcccccagcctcttcccctgagcggagcttgagccccagacctctagtcctcccggtctttatctgagttcagcttagagatgaacggggagccgccctcctgtgctgggcttggggctggaggctgcatcttcccgtttctaggctttcctttccccttttgatcgacgcagtgctcagtcctggccgggacccgagccacctctcctgctcctgcaggacgcacatggctgggtctgaatatctggggtgaggagcaccgtggcctgagagggggcccctgggccagctctgaaatctgaatgtctcaatcacaaagacccccttaggccaggccaggggtgactgtctctggtctttgtccctggttgctggcacatagcacccgaaacccttggaaaccgagtgatgagagagccttttgctcatgaggtgactgatgaccggggacaccaggtggcttcaggatggaagcagatggccagaaagaccaaggcctgatgacgggttgggatggaaaaggggtgaggggctggagattgagtgaatcaccagtggcttagtcaaccatgcctgcacaatggaaccccgtaagaaaccacagggatcagagggcttcccgccgggttgtggaacacaccaaggcactggagggtggtgcgagcagagagcacagcatcactgcccccacctcacaccaggccctacgcatctcttccatacggctgtctgagttttatcctttgtaataaaccagcaactgtaagaaacgcactttcctgagttctgtgaccctgaagagggagtcctgggaacctctgaatttatacctagttgatcgaaagtacaagtgacaacctgggatttgccattggcctctgaagtgaaggcagtgttgtgggactgagcccttaacctgtggagtctgtgctgactccaggtagtgtcaagattgaattgaattgtaggacacccagccgtgtccagaaagttgcagaattgatgggtgtgagaaaaaccctacacatttgatgtcagaagtgtgggtaaaatgtttcaccctccagcccagagagccctaatttaccagtggcccacggtggaacaccacgtccggccgggggcagagcgttcccagccaagccttctgtaacatgacatgacaggtcagactccctcgggccctgagttcacttcttcctggtatgtgaccagctcccagtaccagagaaggtcgcacagtcctctgctccaaggagcttcactggccaggggctgctttctgaaatccttgcctgcctctgctccaaggcccgttcctcagagacgcagacccctctgatggctgactttggtttgaggacctctctgcatccctcccccatggccttgctcctaggacaccttcttcctcctttccctggggtcagacttgcctaggtgcggtggctctcccagccttccccacgccctccccatggtgtattacacacaccaaagggactcccctattgaaatccatgcatattgaatcgcatgtgggttccggctgctcctgggaggagccaggctaatagaatgtttgccataaaatattaatgtacagagaagcgaaacaaaggtcgttggtacttgttaaccttaccagcagaataatgaaagcgaacccccatatctcatctgcacgcgacatccttgttgtgtctgtacccgaggctccaggtgcagccactgttacagagactgtgtttcttccccatgtacctcgggggccgggaggggttctgatctgcaaagtcgccagaggttaagtcctttctctcttgtggctttgccacccctggagtgtcaccctcagctgcggtgcccaggattccccactgtggtatgtccgtgcaccagtcaataggaaagggagcaaggaaaggtactgggtccccctaaggacatacgagttgccagaatcacttccgctgacacccagtggaccaagccgcacctttatgcagaagtggggctcccagccaggcgtggtcactcctgaaatcccagcacttcggaaggccaaggggggtggatcacttgagctcaggagttcgagaccagcctgggtaacatggcaaaatcccgtctctacaaaaatacagaaaattagctgggtgcggtggtgtgtgcctacagtcccagctactcaggaggctgaagtgggaggattgcttgagtctgggaggtggaggttgcagtgagccaggatctcaccacagcactctggcccaggcgacagctgtttggcctgtttcaagtgtctacctgccttgctggtcttcctggggacattctaagcgtgtttgatttgtaacattttagcagactgtgcaagtgctctgcactcccctgctggagcttttctcgcccttccttctggccctctccccagtctagacagcagggcaacacccaccctggccaccttaccccacctgcctgggtgctgcagtgccagccgcggttgatgtctcagagctgctttgagagccccgtgagtgccgcccctcccgcctccctgctgagcccgctttcttctcccgcaggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacggtgggcagggcaggggcgggggcggcggccagggcagagggtgcgcgtggacatcgacacccacgcacctcacaagggtggggtgcatgttgcaccactgtgtgctgggcccttgctgggagcggaggtgtgagcagacaatggcagcgcccctcggggagcagtggggacaccacggtgacaggtactccagaaggcagggctcggggctcattcatctttatgaaaaggtgggtcaggtagagtagggctgccagaggttgcgaatgaaaacaggatgcccagtaaacccgaattgcagataccccaggcatgactttgtttttttgtgtaaggatgcaaaatttgggatgtatttatactagaaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggggtgcgggttgttctctggagagtaagggggctgtggggaacatcaataaacccccatctcttgtagatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgtgagttctgggctctgtgccagcatgatggggagggcgacgcgcatttctcacacggcagggagggccacacgcgtttgtttctcacacgatgggcagggcgacacatgtttgtttctcacacggcggggagggcgacgggcgtttctcacagggcgctccctgggtcttttactcacataggtctaaatcccatgtaaacacgtgttcaggactcaccaagcccctgcttgtcatttaactcaggaaaactctcaggaacgacagcacttggatttgccttaatcttaagagaagttgccttcggaaatgcgtttttctttttttgctcattcatttactcagtgtccacgcactgaccctccgtgccgggtggtttggatcctgctcccggggacagacacacagtgaggggaagccataagcaagtccatgcagacacagcgtcagggagtggtcatgcagagagcacgctagaagccagctgtgcagacacggggcagggaggtcccctctagaagccagctgtgcagacgcaggggacagggatggcctctctggaagccagctgtgcagatgttgggggcaggggtggcctctctggaagccagctgtgcaggagtggggggtggggaggccactctggaaaccagctgtgcagatgcaggggacaggggtggcctctctgagctgacctctgagtagagagacccaagagaagtttctcaaagcatcttatcaagctaggtatggtggttcatgtctgcaattccagcactttgggaggccaaggcgagagggtcacttgagcccaggagttcaagaccatcctgggcaacatagcaagaccccatctcttaaaaaataaaaataaaaaattagctgggaattgtggcacatgcctgtggtcccagctactcaggaggctgaggcaagaggatcccttgagcccaggggttcgaggttgcagtgaaccatgattttgccactgcacttcagccttgctgaagaccccgtctcaaaaaacaaacaacaaacaggcatcttatcagatctcggtcttgaaagcactcagcgcagtcttgcccaggggagggtgggtgtggtgtgagcccgtcctgcgaaattagctgtgctgtgttaacagaggacgcgtcttcctgtggaccggatttatctgcggctttcatttctcggaggtgctgtttgccttgcacttgatccccagaaaacctcaggggtccttctggggcatggctgggctgggatctgggaggactttggccacaagctcctaggcctggaaaggttctgttcagcccctgcccagccttgcttggggtcatgggacaggcatgtgtgccagttccggtaccagccagttcctggaggtcagccccttgggggcccctcaggggtggtgtgggcccagccaggcggtgcgccccttctgatatgccctgagagttgatcacgctggtgccagggtgccaagggctgcagggctcggcacggccgcctgtcccagggtcagtgtgctgcagggctggccaggccactccgccctcccagggcaccagggcccgggggtgctctctgggtgctctcaggctcgtgtggccccttgggtgtgagcaagcctggctggcctctgtcccgcaggctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacggtacagcagcgggcggcgggcggcgggcgggggcaccgagctggggagcgcaggtgctgaagcgccgtctcctgcatgtcccagcccggtgcgaacctctacgggtctcaccctttctacctggcgctggaggacggcgggtcggcacacggggtgttcctgctaaacagcaatgccatgggtaagctgcccaccgcccagcgcccgggccggggtctcctccgtgctgcctgccctggagactggaggtccgcatgaggggccctgggcacggtgctgggccttgtgttttctgggaaatgagtcctatgggctgatgcctctcccaactctggccttctgtgctcctaaggagggttctggggccctgcctggaggtgggctggcaccacatatctttccgtcccatgccaggttcctcctgagtcaggcttagcacggcttccccaggccactctgagctcctcgtggggagagagcctcaactctccgcctgtgattggcccatctgtggggtgcagagccctccaagtgaagaatctgtcccccaaccccagagctgcttcccttccagatgtggtcctgcagccgagccctgcccttagctggaggtcgacaggtgggatcctggatgtctacatcttcctgggcccagagcccaagagcgtggtgcagcagtacctggacgttgtgggtagggcctgctccctggccgcggcccccgccccaaggctccctcctccctccctcatgaagtcggcgttggcctgcaggatacccgttcatgccgccatactggggcctgggcttccacctgtgccgctggggctactcctccaccgctatcacccgccaggtggtggagaacatgaccagggcccacttccccctggtgagttggggtggtggcaggggaggcaaggggctggccgggacgcgtctcctcaggccccagcagacggtcccgtgttgtggctgcaggacgtccagtggaacgacctggactacatggactcccggagggacttcacgttcaacaaggatggcttccgggacttcccggccatggtgcaggagctgcaccagggcggccggcgctacatgatgatcgtggtgtgtgcccccacactgtgggtctttgggaagggggccgcccggtgcccagtggctccttctctgtgcagcgtcatcctcgtgcctgtgtggtcgccgaggatgttttctgagggtctttgtgatatcgagggaatatcaagaagtttgcaggcttggccccagctgtccagggaggtcgggtttgagggtccccagaaatggccgggtgctactcagggttctgtcagatgtaggttacttgaactgccttaaagcaaaaggccaggggcatgataaactgatgtcacctggtcctggaaagtggagggcccggtgggcctgggcatgggtatcgctggaactgtggaggctccgtgtgccttctggccgtgcctctccttctggccggctctgaatccctggaaaggacggcgtgagtgagggcagcttccagccctcatgctggcaccacagagcggagacttcttcccatcagctcccatagaaaagtcccaaagcaggactcttgagtcacccagcacaaagaggcccttccctgagccagtcccacagccagaaggatgcagtttgggggctggtccagcccgagtctggtgtccggcacgatggccagaggaggaggtgggaggcagggcgagctgaaaagatccaacagttcctgcccggaagatccacttcagcagaggaagcacagatgagatgtggggctgtgctgatgctgcctgtttccatccctgccttctgcaggcagcaaacagtagtagcccttaagagcaggagtggaaacacagacttttttctttctcacatttttttaattataaaagaaaagtgattactgtagaacacttgggaaactctagaggtttaaagaaaaggtaaaggtaaagcttccattccggcgcgcccctcatcagccagctggtcctgactcgcccggccctggctcctctccaggcaggcgtgtgcaggcatgtgcaggtacacaggcaggcatgctgtacacacgcatgatgtcatccccagcctcatcctctcactgtctcagttttccccgtggctggcgccagggctctgggccaccctcaccttgacgggtttccctcttcccaggatcctgccatcagcagctcgggccctgccgggagctacaggccctacgacgagggtctgcggaggggggttttcatcaccaacgagaccggccagccgctgattgggaaggtagggcgagggtccaggggacgggggttagaaagcagaggcctccagccagggggagccggcagctgctcaggaagacggtgggatttgaggagccatcacgcccagtgggacagctgagaggaatgggccacagtggcccgtgacgatggtggctcctacaaggaatggccccgtgagttcttccatcagcaggcctttgacttcatgggcagctgggcctggcccaggcacaagccctgcagaccctcagtgaggccttagggtcctccttgtcctcccagccccccaggggcctccaggcagggcccccgctgagggagcagctagggagggtctggtgcggatgtgaggctgcctggcagggcttgcacggggccgtctccgctgcccttctccctgacgctctctggttctgcagcccagcccctgggtggacgtgttgggggtgacccctcgttttcccagggttgaggccccttggccccgcatcagtgccttgtggagaaagagctgctcattgacctccagggtgcaggtctctcagatttgcaaatgtgggcgtccactaagagtgaggctgcccctctgctcaggctgaggctcagtggggcttccatgcaggccctgggtggggccgggtctccccactccagcctctcgttgtccaggtatggcccgggtccactgccttccccgacttcaccaaccccacagccctggcctggtgggaggacatggtggctgagttccatgaccaggtgcccttcgacggcatgtggattgtaagtgtggccccctcctgagcatccccaaggcctctggggactaccacaccctcctcactctgggcagagtcacctaccagcagcgcttctcttgcaggacatgaacgagccttccaacttcatcagaggctctgaggacggctgccccaacaatgagctggagaacccaccctacgtgcctggtcagctcgccccccacctaccctggggacttaatcaaatcagagactcccttgtctggcctgggagacttagcaccctcatctctgagaagcagatgggccagcggggaaaggggtgggggggggatccccaggagaaaggctcaggctgggagactcagccaagcagtgcagacagggtgggtgcagaggcacaggccctgccggaggagacgccgctcacaggtgcttgccagagcacagtgaggccgactcgactcagagccgtctcgataggcgcagggaccatgcagcggagacctacccacccgtggggagaggtcaggcccaactcgaatgcagcacgggcaagtggatttctagccagggagcagggtgggctcagaggcaggaattaccaagaagaagcatgggggtcagggggattctggctgaactgacccagcaggattcttgctgaaggcaggccagggtgaccagacatcgcctgaggggtggtggaggttggggcttctcgccaaactgtcttagcaggaatggcagaaactgggttttacaaggaagtacaaggatgggcctgggagaaggtttgggggcctgaggctatagtttggcccagcaaagaatcagtgagaggatggggttttgggcttaggtaaacaggcaggggagtgcttgaaatgggccaagagacggtggatgtgaagtctgggggtctgcagagcccaggctccagcacccgcccagccctgtcttagaagcagtggagatggttacccaggttcccgggtaacgccagccccacagaggcgtggggagcggctgcaggtgcacctccagggccagcctgaagaggcagcgacctgcacaggggctcctgggaggtggggggcagggagggcaccttggagcctgccgggaggaagctccctggaaaccagcccccgcctcttccaggggtggttggggggaccctccaggcggccaccatctgtgcctccagccaccagtttctctccacacactacaacctgcacaacctctacggcctgaccgaagccatcgcctcccacaggtgagggccacgtcccgccccactgggctctgccctcacagcctgtcctacaaggttggggcctctgcagggcctcagggaggaggaaaagcggaggcccagaccacccggggcccgctggcggcccgagtgctctccccacccgctgcctgcaccccagcctgaagctggagcgctccttcccacttcatgcctggggcttggagaggaaggaccctggatgctgacaggagtctgcatcagcggggacctcatgactcctgtgaggctggggggggtcctggctcacctacaggcatcaggtggcccagacagaggcaactgtgcccgcagacatgggcagtagcctcgccgtcctcctccccagcctctgcctcatcccagaaagctccttgctcccagctctgccctgctggtgacagggttcccgagtgaccccgctccacacagccctcacggtgtcccccaccaccccagggcgctggtgaaggctcgggggacacgcccatttgtgatctcccgctcgacctttgctggccacggccgatacgccggccactggacgggggacgtgtggagctcctgggagcagctcgcctcctccgtgccaggtgagctcctaccaggaggggctgctcagcagagtagagccgggggcctctatgggaggcttgccggggccccccacccacttagcaggtggggctctgggtcacttggcctgagctggctctgctgcagcagcctgaggaccagcctgactctgccctcccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctggtagggtgggggtggcggcatggcaggtgggcgatcccacccacccaagactctcccctgggaatcccacccctgctggagaagcaccccatgctgggtggctgagaagtgcagctctcccgaggcggggactccaggggaccgcggccccagcacccaagtgcttcctttgcccccgcctgccctgcagccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagtgagtgacctaggcaggggcggtggcccatgtgtgccctgggggaggggcacgtaactcccaggcagccctgtcctgctgtgggctgtgttccccaggacccagcaggttgccgctgagtgagacaacatttgggcctggcttaagggggaagggcagcaagaaaacccagtaatatcccccagacaggccgtagtacacacgaggagttcctaacaacagccctgcacatcagtgtgttgagggaggattcccagagagtgaggtgattagttaactatttgcagaagtcaatttatttttcttgcataccatagaaacataagttccagataaattaaatagttaatgtcaaaaatcaagctgtggaggccaggcacggtggctaacgcctgtaatcccagaactttgggaggctgaggcgagtggatcacctgaggtcaagagttcgaggccagcctggccaacatggtgaaacccatctctactaaaaatacaaaaattagccgtgcatggtggtgggcgcctgtagtccctgctactcaggaggctgaggccagagaatcccttgaacctgggaggaggagattgcagtgagccgagatcgcgccactgtactccagcctgtgtgactccatctcaaaaaaaaaaaaccaagctgtgaaagactccacaggaaaagataagtgaatgtgtatctctggggaaaggtttcatttagagaaaaaaaaaaaaaaaaggtgaactttatttgaccatagcagaaaaaaaaatgtaaatctctgaatataaacacaaaaagattaaaactgctctgaacatggactgtaacagcagagaaggcattgtcaataaaacagcaaatagctactcttcctaataggtagagaactcatacgttggtaagaccaagactaagaaccaaattggaggaacactgtttgcaaaacaggagatacgaatggtatccacacattcttcacccggaaatccaagaaacgcaatttgtgttttaattactattttaatgaccttgttgtttctgtcactacacttttttttttttttttttagtggttgccctagggattacaattaacatcttaattttagcctcgttggaactgatgccaacttgctttcaatagcataaaaaagctttgcttctatgtggtttccattgcctctcgttcctctgtgctgttacacgtctgtatccatgatgagcccatccacgcagatttataatgaccgccttattcaattatcttttaagtcaaataggagggaaaaatgggttacaaacaaaaagtacatacacactgtctgccttttatatttactgatgtagttacctttacccatggttttatttcttcatgtggctttgacttcttgtctaacatctttcatttacagcagaaggactccctttagtatttattgtagggcagttctgctagtgatgaattctctcagtttttgttgacttcagagtctcttaatttctccttcattttttgaaagttctgctcaacgtagggttcttgactggcggtcgtttctctgaacactttgaacttgtcagcccatggcctccgtggtttctgctgagtagcttctgtcttgcctcttcccagattctctgtctttggcctttgaagtcccgatggtgtgtctaggtgtagatctctgagtttatcttactgggagtttgttgagcttcttggacgtatgcattgatgtttttcatcaaacttgggcggtttttcagccattacttcataaaatattttttctgcccctttctgtcttctactctgggacttccgttccacacattggtatgcttgacggtgcccaggggtctttgcagctctgttgactccttcctcgttgtgttttctttctgttcttcagactgcttagtctgactgccctgtcttcaaggtcactgattcttttttccaccagttctcatctgctgttgagcccctctagtgaacttctcattttagttgctctcttttcaactccagaatttctgtttcattcctttacgtttctctcgttaaggatattccctatctggtgagtcatgttctcacactttcctttagttcttcagacacggtttcgctgagctctttgaacacatttaaagtagctgacgtaaactctttgtctagtaagtccaatgtctgggcttctctagggacaatttttattaactactgtccccccatctgtgggccatactttcttgtttctttgcgtgtctcatacatttttgtttcagactggacattttaaacgcagctgctgtggtcatcagattccccatccccctcaggtctcgttgctattgctgattgttttgtgactttcttgagctaattccataaggtctgtgttcttcattgtgtgtggccaccaaagtctctgcttgactagcttagtggacagccaataattggtcagatatccttcacagatggcatccgtgagtctcccagcctttgctggggcgaggtggggagcaccgtcaacacttagctaggccaaggattcttgctgttcttacaaagattcagccattttgttaaatacatgctccccagatggctgcaaacccttggttagtttcaagagtcctaaaaatgtcaactctgaccatttttgccgatgttcctgttttcacagaggagaggatcttgagaggggcttactccaccatcttcactgacatcactccaagaaatgtattttgcaagaaatattttgaagcagaaagacaccatttattttgcccatgaattagaatacattagagaaaataagactatcccttgctggcaagaacacagtgacacagtagggtggaatataaattggcacatttgtggaaagcaacaatacatatcagtcaatgtttttgagattcacattgatgcgttaattttacaaatagaaatagggcctaaagaagtcacctcaaaaggcatgaacgctccatgaatgtatccatgcagggatcatagctgagcactggatgccccctgcacgtccgggggcaggaaacaggacagggcagagctgcgtcacagggcaggacagtctccgttagacggagaatcctccgtagagctgcttgcacatgtacattcatctttttgtcagatgttaattcaagttgcctttggttgtgggactgggaggatcttttctctttgttgatactttttcgtactttccaaatacttgactgatgagcacatgctgccttggttaccggaggataagtgagcgagcaaagtgaggccagtgctgtgtccatcctggtgcctcaagcacaagcccctattcctgccctgagcccagctgccggcatgtccggggagaaggcttctcccagctccggcattgacttctatctgctggaatcatccctgcccgtctgacctgagtcctccaagtcctccggcaccttgagctccagagagcagaattcagcctcttcctgtgcctccccagggtgggcatatgagccagccccatcccattcatcacccgtatgcctgtgtgcccatcccccttgcaggttccccaaggactctagcacctggactgtggaccaccagctcctgtggggggaggccctgctcatcaccccagtgctccaggccgggaaggccgaagtgactggctacttccccttgggcacatggtacgacctgcagacggtgagtctggggaccctaaaccctggggagacgggagaccagagcagccctcccacctgccccctccacccagttggtgtgaccaggtggcggaaagaggaacgtatgtgttgagtcccggccatgtgccaggcccccacccggctgctccgcacccatcagcctctccgctcctcacaccatccccatttcccagatgagcagactgaggcctgcttgcagaacctggccaagtcccacggccatcacaggctgtgcctgtgctgagctggcatacccaggcctctcaggctctgtccccactcagtagccaggagggtccctacctacagtgagccctgagtctgcgcctgaagtcacagttcagcccgtctgtgccaggcctcctaggcctccacgtggagccccgggagatggagagcgtggttcctgaggacagcatgggggcctcggcacggcccagaatcctcaaagcaacatctccctccaggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcaggtacctgggccaggcggctatggtgggggtgtggacagcacactgcagagctgggggaggcacagggagatggtgggggagaggcccaggtggggcttctgaggggccgccccccgcagtgtaggttatcaaggagccagccaggccagtgaggtggggagggcacagccccacaaaggcgtggagcatggccggcaggagctcagtggtctgcatggtggaggttctgccgggcccggcctcgggcagccgtgggatagcacttgaggtggggaaggtcttgggtcatcaccacggggttccagcccctgcggccgcaggtgttcctgcagatcctagttactggcagcctggtgctgtaccagcctagcattcccgggccctggaggcctccacctccaccagggtggggatgatgacatcacgtgtccttccctttccagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaatgtgagtcctggggctgctcaggctggtgggcaggggccggctcggggttgagaaggggtgaggggacctgggcttgggggtcccacgatggctacctgccactaggacactctagcaggtggcctggggtcctagagtgagcagtggggccgtgcactctgccctttcgtgtacacagagggaggtcacctccctgatgccatcatgagtccctgttctcatgggtgttcctgccccagctgtctgctgacacctccacattctctgccttttcatctctctctgctcggcccagaacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggcaagagggcccagagtggcacagggatcgcgtcccccagccgtggtgcagggggcagaaggtgctgggcgtcctggtgaccgatgccaggaacagaggatgctgggacctcccaagggggtctttggggaggagtgggaagggtcaggccacacaggctgtgcctttcctcctcctgtgtctacacgtgggtgatggggccacaatgacgacctctgagccgtgttgaagcagcaccgcgtttctggcgtgcgttaaggtgacccgcactgagagccggggtccccctgcgcctgccggggaggaaccgggtgcgaagcatcccagggccagacggagctgccccctgagcgccgggcctcgctgctgctgggatctcggggccagatggagccgccttctgagcgctggggtctcactgctgctgggatctcgggctgctccatttgtgctctctcttttccaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggccctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgcttcccggctgcccagagggctggatgcctgccggtccccgagcaagcctgggaactcaggaaaattcacaggacttgggagattctaaatcttaagtgcaattatttttaataaaaggggcatttggaatcagcttctgcgggtctctctgggattcagggcagggaggatgtatccaggggccctggaacagaggcagctcctttgtcctcagcaggcccccagacattcccacagtgggtgtgcgccgtcctctgtctcaagccggcatccatcacgtcatgttcccatgtcacgaggcctgacatcacctcatgtcctgtccccatctcacctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11766 - DNA, 64489 bp, Human
agctttacaagtaagttacacaaacagctacagagatgagaggagtttcttataaaagcttttggattcaactgtaaaagtggcaaaatggcaaagaaagaaagctttcttctttcatataataaactttctcttcaacctcactctggtgtccacactccttaattctcttggttgtgagacaacaagcttggtaacacctcagacaacgagaccactgaccactgacccgtttcacaatgacgtactacaggatggtgtatgctgggtattcatacatcgtcatgcaacttcctagttttatgtgtaaggtagtttcctctgtcatcaccttggtatttcccatctagtcacggtattaagtgggtcttatgcgcttgttaagagctggtaagagaagcttaacattcacttgatggaatggttactgtggcttgtatccacaggagctccagctcatgcttaaaatactgtgttagaacaaatggatcagagtgaattctgtaacagtaaatccacagaactgaaaattactgacttgcatcataaactggttgcagtggcaaggcagagagttcagattcgtgttgtactgcggaaagaagaaaccaaagaaaataagtggttcatacacaggggactatttaactgatccaagccagaagactactgagggtgaaaggagcattatcagtaattatgtttagacaaaagttgtgactgtccttagtaaaccaggatagacgtagagtcaattcaaaaagaaagaaagaacaaacatatctaatgtacattaagaacccagggatatcgggttcttaatgtgcatatttattggattgcccagagctttgaccttcaagtataattgagttcttgaaacttagatttaggtttgtggttaaggggcaaaataatcagattccaaatagggttctgcagacaaatcccacaggtcctaaagtctctgggtcttttccttgccattgtggtatctcaggggcttgtgtaggcaatgataaccagttccatacttctgctaagagaaatttggggatcagaaaatctttctctgcagctcttcagagtctctttaatttacttcaataacaaggaaatcagaaatctcaggacagtgctggatgtggcagaaattcagggcaattcacaactttcctaccaatttagagttacctgtctggaatcacttcaactgacagtggaagatagtttataaaattgtaggggaggcaaaatttcaccttcgtccctgtagggtcccagcatggccctagtattaaattgatttaagatattaatagactgacaggagacaaccacacaaatgtttattttacatagcacgggggccctcattaaaaaaaaaaaagacctaaagcagcagttaagagccaattgcttatagagtgaaatggacaaaaaatagtagttgtgaaacatgataaggcgaaggggcttggggtaaagaagcgactagaaagatagggattaacaaattttgtttggacagatttccctcgacttcaactttctgtccttgaagataacaatgttattttatagggaagacatctttcacatgggaatttcatctcctccttttaagacacataatatccatgacagtgatcttgcacctgctgtttttaagtgcctttaatttaaaatagtcaatatgccacagcagcatattttgaggtggtatattattaactccttcaaggctaaaagctttgaatatgccggggtagttaccagactggagaaccttctcagctatttgccacttgtggaatgcattcaaatgtactgagtgcttattaacttttctctcagtccctcactctgctgctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggtgagcggcaagctgcggggatacgcggggggcggcaagagcccgccccgtggggccagccccacaagcccccgcggcgttgccctgcgtttccaccggctccactctccgccgcattcccctagggtgccagtcagcaggcggttggggcgggcccgctgcggggctggggcgggtgctttctcgtttaacacgaaccagacaggcagttaggtttgaacaaatgaggatccggaggtccagagagtataggtgcagagagtaaagtgacaggtctaagtagtgaagtagccggggctggaaccctcgtcccaggcagtggggcacaggctgtcttcatcgcggagatggcagtcggggagcgtcgctccagaaagggccagggagtgcgggagcgtccgtgtgcgaaagagaacgccccagtgggatgctttggctgtgtctctcccttttggaggagttggtgggtggtggagtcgttaagtcccgtgcagttgttagtgcagggtaagaatgggctcctccagagagggtagcgccgaataggatttcgtttggaggcaggactggtgcctcaaggtctctttaaaaggaagataagcgagcggcctgaaactaccgggtactccctctgggcccatgggcttcatggtggccgacctttgggtgagaaggtttttgttttttggttttgtatccgaaattacatctagggctaatgtttcttgaaaatgttaaggttgaactcggatttttggggttgagttggatggagcttgcatccttacattcaactcagaacaagcttgaatgcctgctgcaaggatgacctggtctgtagtgtgaccacaagatataaccttctgctaggggaaatttttttccccctggagttagctgatcctttttgatttttatgttttcattccctaatttgcaatctctccagccgtgctgatgtgtatttcaggggaaacctgtgggccgatgagttaatgcatttattctttgctactactattctcctttttatgtttttgggctaaacctgaaacagccaatatttcatggagtgaggccccatcttttttatagctttacttgtgatactatatctagggtaagagcttaccgaaaaatggaagtctttgtttccattaggtttattaagcccagtttaaaattactaagatgagaagaatcatttcgtaattcaaagtaggaaactcctacctaatctgatagaatatacaattattagtatccctatatagttcattactcctcataggaactcactaaataatgaaaattcttgcaacattatatttgcataccactttaaacttctttgtggagtccttggttcctagcccaggttgtgccagtaagtgtttagagtgctgtcatttaatcttcatgtcagagagggaaagcggtatggtacagtaagtagttaagaatgtagggccgggcacggtggctcacgcctgtaatcccagcacttcgggcttccgaggcgggcggatcacgaggtcaggagatcaagactatcctggctaacacggtgaaaccccgtctctactaaaaatacaaaaaattagccagtcttggtagcacgcgcctgtagtcccagctactcgggaggctgaggcaggagaatcgcttgaacccgggaggcggaggttgcagtgagccgggatcacaccactgcactccagcctgggcgacagagtgagactccgttcaaaacacaaacaaacaaaaaaacccaaaaaccaaaccaaagcgaaacaaaacaaaaagaatgtagactaaagagaagattgccaagagtgtcttctgggttctgccacttcactgtgtggccttggtgggttatctattataactcctctctgcctcactttctttttttgggatacagttatacctgcatggtaggagcgccgtgaggatagacctaaagtacttaggatgatgtcttgcacattactaattttggttaataaccattttcagggattagggaggaggaagttatttcaaggccactgaatgatgaaatgtccccaaggctttttcctgggcctgtaaacagttccaggcctcattcaggcagtgtggttagtaatcccgtgatttgctattgctagatggtgcattttaacatttggttatattgcctttgacttatgctgttgtgttaggtgtggctataggtttgcaataacatgattggtgtgtttgcctaaagccgatactttctctgttaaatgtgggagtgcatagagggcaaaagaaaccctagacagcaaaacgcacagtattaatggcgtagcgtaggacaggaagcattgtttacctagggtcaaggatatattagtgtgcctatacagtgttcatttaaagagtgcctattttaatattggagcctctgctaggttgtaagctctttgagaaatatgtattttaaaaaatttgtgtatataacacttgcctttattgagaacttactatgtgccaggtaatgtgccaagtcctttacatacatctaattttagtcttacagcagttgaatgagtaagatagcccactttacaataatttgcctatgattacatagcttattaatgatgaaatcaggatacaaactccatttgactcaaagactcctatttatgttgccagtaccagtgcaacaaaagacccataaaatatttaataagtgtttattgaataacaaagaatgaggatacaaacttgaataagatacagtccatgtccttaaggaactaagaggtgagtcagaaaaataaaggagtgccggggttcaaagtgttgtaataaagatatggacctggtgccaaaggagaggcgcttacatcaaatcagtgagcagggccagaaggcatccttccttcaaattccagaggtggaatttgagctgaaaggtgaattggagttgtccaagagaggatgtggggtgcattccaggcataagaatagaaaacgttgtttgatacatctaggtagaaggtgtgagagtgataagggataaagtatcagggttaggagccaaataattaagggatttgggtgcaaaattgagcgatttgaactttatcctgaaagcttttgggaaagggacggtcttagcatgtttacatggaagagtttcgtgattacatttgtattttgggaaggttactctcgtaagtagcatggaagatagaatacagggagaggcagaagggatgtcctgagaccacttatactgttctcataagtgaggagggcctgggtaagtcagtggggttgaagagtagaggagggatttgagagctattgaggatatcttggtgactgagggtacatgggaagtttggacaaaaggtggcccaagtttatggtttcggcaagtgttggttactgagacagcaagttcaggaaaaggagcagatacatgcaaaagtgctatgtttggtttgggatatattgaggtagatggaaagagtggctagagagcagctccatgggtgtttgcctcactggtagggactggggatgttttgggtgtgacagagtagatatgggcacttaccagaatgtcagtggtagcatatatgagaatataaaatagaaagttgaaccccataaaagtattttgtcccaaccatcatacatacacctggcaaagtgtcagcagtttgaacctaggactgtctggtttacaagcctgaggctactgtttcatgccaaaaaccggcctctttttatttattttttgcttatattgcctcccaaaggatagattatgggtcagttactggttttgtgatttcttttttcaaatagttgtatgccgtggtccaggcatgatccagtattggtccctgcgctgtctacccttgtctttccatgcattctgatgccactcttgtgttaagttttcttagtacagcctggtctggagattattgctagttattcttaatagtaacaggtagaatttatgaggatggggaaagtagtgcttcctttcagcattgctgcttgtgatgtttttccggaagatgttaaggggaaaaattacctgacattcatccctcccattttagtcctgagatattgttgtcaagtggtctcaagatagaaaacctgagtttcaagataagtttgtgatcatgaggttagcaagcttacctcccagttagccctcatgccagaagaagagaacttttttagctgtcggacagacagcagccctacttgcccaatgattggcacagaaagggcagacagacaacttgtgaggaacttttcctcagcctgaccttgcctgaggctaaatatgtgtataccaggtggtgtgcgtgaacactgtagacagatattcatgactggatttcttttattcatacttttgaaaacttttttttttaggcaacctcccgacttctagtaaattacccagagccctatcgttctcagatattggattatctctttaaggtaatgaaaacataattatttcatggtacctgtgatattttagaaattggatggtgaatttcaccatagaatttattagcctcacaattctagtttttgaaaaaatggcacattacttttggaataaattgctatttgaagttttgcttttgtttttgcgtctgtaaaacctaaggcagtaattagtaattgtcttgaagcttcatacaatacaacactatgttaatactgttacttcttttcacagccgaattttggtgcctctttgcatattttaaaagtggaaataggtggtgatgggcagacaacaggtaggagaatttgggagataggatttctcccatcaacattttaatctatacctcagcatatggactgtgatttcagaatatgtgtaaacaataccaacacttttgagattgattgttgcttattagagttttcctcattttttaactgtaattatttaaaaatattatatagaatatgactggtccatcaaaaacaatattcaaacttcaaattgcttatttagttgaagtaatcggtagtaaacaaatccacagttttctaaaacctatatatacaggacagagcatagggacagttttgaattttattgagcagttagaaagattttaatttcgtatagaacaaaaaaagtgttattaacttaaaatatgtggtaaaaatgatacagcttttttttcttttaaaaacaaaacttatctttaatcactaaatcttcagtcttcattgtcactattttgattggctttatgtagtccatgttatcaactggcagtttataggccttttgtttccaggaagaagaaaagaaattctctctatgattagatatagcttattatttacagaacagattccattataatgaactctagagtattacttgtattcctgctagtgatttggaagtaactctttgttgaacagatatgtctgtgtggtggtattagtgtttatgttgaagaaaaagtgcaaagcaaaaacaaaagaaacccccataacagaaactttcttcaagctattgcgttttactgttaaaaccttttaggcagaattgacaatgatggactaatttcacttgctgaagctaaattagaggtagaggtacataaacaggcagttcttgtgaattctgatgtttacctttaagaagaaatgggcaagggcctctcggaaggccctacttagcaagggcagatgttggtgaactgtgggaatatacgaggactttgatagcaattacctacctcagtgctaagacaatgtaacctctactaactgcagatgttagtatagaattttgttatttttagagtggatatgtatactcattcctttttttttcctcaaaactcttcctatatcaagacatattataggctaaaggtgtgggttctgagaacagggctcacgagtccagggattcatatccagcgttgaaaagctgaaagttgaggtaatcagaacttaaagttggacatggggatttgaaaactacagagagatcaaaagcccagaagcatgaatactgggaatttttagttatatgaggtgataacatttctctcagtactgcttgtaatagaaggttgtggttttattaagacttttacaatgcttaagataataaaaaaaggatgaaatgatatgcttttatcatccatcctttagttgtgtaagattatgatttccccaacttcaggattagaactggaatactgcttttgtgaagtgtgtgtctggggtgggggtggggagtgagatggtcctaggaagtaccattcatggatcattacttccgtttttgctctcctctattcagacggcactgagccctcccacatgcattatgcactagatgagaattatttccgaggatacgagtggtggttgatgaaagaagctaagaagaggaatcccaatattacactcattggtaagaaatgaagtttgcaatgtttcttcagtctcttttcctttaacttttaaattctgaatcgtgttggtggaatctctattaatacggaagtactcataatgtcattaatgctaccagtatgctaccagcagcaaagcatgtgccaggggtgatcctttctttgcccttgtatattatgttgaatccttataatacctgtggagtaaggcatgactctttccattttccaggaagaagcagtagaagcttaggaagattatgccactgacctaaggtcatagacagttagtaaatggcaaaatcggtgttagcacctaattccatgtttcctatgatgctaaactactttccttcacaagatctgtcatcagtatttataaaagggtaatactgttcacaaaaatgtatattacatgcagtagtacacctaactagttacaaaattgtatattgcatgtagtagtgaaccctatttttagaaaaggtacatacaaaagtgttttttgtttattagttagtttttgaacttcaataatgtgctggttactgttctgggactcaggaagccaatcccgtccccaattcctgcacctgtggggcttaggttctattgggaggatcattggctagttgcttaaatgggactatgtacatttcacagttctgtgagaatgtgtacagagcttgtgaagtatttcaaacatcaagagtgatgggatactttcatcatttgaaatgaatttgattttttgaaacaggcttaaattcaaactaagttaaatgaaattaatgattcattttaaagacctgatttctagttatttaaaaaataattttctcaacaatcaggttaatgaaaagtaatattttctaagttaaaagaaattaggagtaagtatgttctttataaatgggcttttgtaagagattccagaaatgctgtgagcagtaaaagcatcactgaattcagcacatatccactagactgcttccaaggtcagacctcatttaaatgtagaaaatatggcatgctaaaccatgtcctaacaaagacttggtaggccttcagattgcatttagcatttcattgttttcaagaattctattactttaatgtcacatttcttatgtaatacacttgggtgttcctcctgagtttagaaaataagcattttgtcattttgatttttatttttttcagtggtgaactagtttggtaatatatttattgctgaggaacttaactattgagcctattttaatatattagtagcaagttaaatttagaattataataagtacttttctactcttcttatttttttacttaaacataatcaggattattggaagaatatggacttatttgatgtgtatcacttaacaagggtatatttctctatggagtcattgtcatttatagtgatataagaacaaactagttttgctaaattagattgcctgactgattaatattttaaggaccctaaattgtaagaagatgtacaattgaatgataaatttgtgttatacataactcaaaggagtagtttggcataagccttttagaattctttgatttgacctcaaagaacagaagttgaatattgaacattccaacagtgagtggacatgttaagttaaaacatatggtacatttctttctattggtaagggtcttggagagaggtgtttgtatttgttatttttcttcttcttggaaagaacatttgaaattatgggacctgactctagggatcaataaggaattatagtgtctatagattggaaaggatttcaataatttttatatggtatataaactttcctttagtcagatctgtattggttttttgctagttgaatgcttttcttaaaaaaaatttgttttattttcaatagcgccagcaccgttatacctcctctacctttgcctcctcccttctctctgcagggttgccatggtcattccctggatggctgggaaaaggtttcgactggccttatgtcaatcttcagctgactgcctattatgtcgtgacctggattgtgggcgccaagcgttaccatgatttggacattgattatattggagttagtaatatatttaaaatatgattcagttttggacatttgtttgtaatttagaaaataatttgattctgtggtactttttgactaaccattttatgccatgaggctaatttgttctaatggtgtctgataataacacaaactaagtacctgtgacctttaattgctcccctttgcccatcccagtgttcccacttttgaaaactgtgttgagtgtatacctccttcctctgagctgggtttttttttttttttttttgtatcaacccaactcaaattctccttcaaagctttccctgctttctctggttcctacaacagtgttgtgtttcctatacagcttatggggggttagtctcattttatcctcttgttgtcttaagccaaagattggcaaactttttattaaagggccagagcataaatagttttgggtttgtgggccaaaaggcaatattgaggatcttgaggtaaatatatagccatttaaaatgtaactatttaaaactaaaaacacttttagctctcaagttgtaaaattacagatgatgggccagatttggcaggctggctgaaatctgcgttcacctgtcacaaactgttagttaacaccttttaaggatttgaaaagtatgaaaaatgatatcatgtccagcttgtctcttggctgggtggaggcatgccccaggctgcatcgtaccccacagggccttaacacacacatagtgggtctccataatcatttgcttattaatataccatcagttaaaactaatacttaaacattttcatgcaatcatgacttagattatcagcaaacaattattgagttcctactgtgttgcaggaactgtgactgtaatatttgagggctactaagattaataagctcttgtgttcagtaagagaagtagatgctggaacatataaactgtaatactacatgatgatacagggcatgaggatgagccaagggctggaggaagtcagaagaaagaatatactagtttttgctatccttttccaaattatgactgaaaaattagtttatatttgagaactttccttttttttttacactgtcacccggattggagtgcagtgttgtgatcttggctcactgcaacctctgcctcctgggttcaagtgattctcctgcctcaagtagctgggattacaggcacccgccaccacacccagctagtttttttttctttttattagagacggggtttcactatgttggccaggctggtctcaaactcctgacctcgtgatccgcccgcctcggcctcccaaagtgctgggattacaggaatgagccaccacgcctggccggagaactttcttaaatgtcaggacatttataacctgtagtgagactaaatgtaggtttggtctaatagctttctcttatggtacagtcacaagtaatgggtgattcacatcttgtttagactcatgataacaaatgctatgatgaggaggttcattgataaactctttcctgtatcattggagtaaaaagacctgcacctggattctagaatcgtctcttgttattaacagttttctcaactgtggagttatggaagttctttcaattctaaaaccccatgcttcatgactctaaacctaatagatgtatatatgttccttttatccatcctcattcagagttgcttttgtgactagtgtattactgtgattctctgtgtatgcttaaaaatatgccttctatacagtatacatattaatacttggctttcagggatcttgtcataattgttgtaacagtttccctgtctattagttctccaatgcctagtatagtttctggcacacattgtactgtcagtatgtgttgaatgaattaatgaatattccattgttgaaaatctttggaataaattactttttgaaaaatacccactaaatattttaaggtttttaaaaataatattttaatttttaaaaagttgtgctatcttataactatctataaattctatggcaggatatcccataaagttaaaaaatggcgtatcagataatatgaaagatgatgagagaaatggtatcgtaacgataatctgctttctgacattttgtaactttcaattcagacttttttgactttttgttttgcagatttggaatgagaggtcatataatgccaattatattaaggtgtgtacaactttagtatctttttgtttttaactttttagtgaataattccttatggttcctaacacagaaaatagtaggaaatttgtgttggaaataccgtattttttatactacagttatttattttgctggttgtgacataaaattcaagcaaaatcttaacaatgtttatattcctgatattaaagcatatgtaattctttgtgagccccgaattacctttgtctaaagagttgtgttgaatttttctattttaaaattcattagttttggaattctgataaattttatgaaacaattatatcattttagatttttagaacttcaagaaatgtagctttttttctttgtcttttgtcaaaacttatggcatatattctaattcttgttttctattggagtgtgttatagtacatgtttctctttgtgattagcaaagaggtagcagtaacatctgccaattgtgttatttttgttccacttttcctatttatctccatttaattctcacaaccttacctatgaggtaactactgtaattgctattttccaggaaaggaaaaacagaataataacttctgccattggaaaaaaaatggcagtttcacttttcaggtggagctaatctttagtttacttttcacttccttttgtcttcttgtatgtatcttttctctaagaaatataattttgggacagtattttatttcaagttttcaaaaatttttatattaatttttttttatttccataggtttttggagaataggtggtatttggttacatgagtaagttccttagtggttatttgtgagattttggtgcacccatcactggagcagtatacactgaaccaaatttgtagtcttttatccctcacctccttcccatcctttccccgagtccctaaagtccattgtatcattcttatgcctttgcatcctcgtaacttagctcccacttatgagtgagaacatacgatgttttgttttccattcctgagttgcttcacttagaataatagtctccaatcccatccagcttgctgcaaatgccattaatgcattcctttttgtggctgagtagtactccattgtatacatacaccacagtttctttatccactcgtactgattgatgggtttttgggctatttccatattttcacaaatccatcaatcctgctactgggtatctacccagaggaaaagaagtcattatacaaaaaagatacttgcacatgcgtgtttatagaaaaaaattttctttgaattggatgttttatgttcttaagtagataaggttcaatacatttctttcatctcttcattcggttaatcatagagcatttatttgctcaacactggtttgtcaggcattgtgtgtatggttataatataaggatagagaatactgttttctgcccaaaaggattttttgtattggggagggtggttataaagtcagatatagacaattaaaatgtgtcataatttggaatgtgtcaaataatggaataatacacctacagggttcttaaaaggcgcacagaggagatgacacctctccctgggttgattagggaagtcttttagaggaggtgatgtgtaatttgaatcttcaagaacggatggataggaactctccactttgctaaggcaggggcatagcatgtgcaaagaactgaagattgagaggtaaagggatatgggggaaaaacaagtcatgaaagatggattagacaatggaggaagagtgggggcactgacccccatcagtaagctaatgtattcactggaataatggctttttttttttttttgacagagtctctctctgtcacccaggctggagtgcagtggcgccatcttggctcactgcaacctctgcctcccggatttaagcaattctctgcctcagcctcctgagtagctgggattacaggtgcccaccaccacgcccggctaatttttttgtatttttagtagagacggggattcaccatcttggccaggctggtcttgaattcttgaccttgtgatccgcccgcctcggcctcccaaagtgctgggattacaggcatgagccactgcgcccagccaataatggcatattttaattaatctgtagttgtaggcgtggagaaggcatagattgagaagatctattgcagccagagctaggtactcaagggcaattccaggttgaagtatgctgatgggagtgtggtggtgggagcaggttgggtgggggaggtggggcagtggagctattaataagattggagcacagggattgtaagtggaaagtcatgcctgctgtgagcacaggtctgataagagcagtaaggggacagagcagaagccaagttggtgcatgtatactggataactctgtaatgaggtagatggtgttgctacagcatcttcatagtgaaaggtgatgaactttttaaatacccaaatttgacatttcaaagcttaagttttattttcttgtgattgtacacatgtctctcttgtggtcatttcatttgagggaaacattaaaagtattacggtttccattttcttttaaactaatgaaataagacagggctatattttatgttatttgaacttttttactattaagagtctgttgctgactccagtgcattctaattcaactaacctggtttgaaagactaattgttgctctaagacatattttcagtgtttcagacagttcagacttcatttccttttttttgaaccttgagttttcttgcagtaaaatctctcaggatacaaaaactttttactttgtgtttgccatttttttccagcaagattttattgggatctgtgttccgtttgttgaaatgcctgttgcaggccaggctcagtggctcgtgcctgtaatcccagcactttgggaggctgaggcaggtggatcacctgaggtcaggagtttgagaccagccagaccaacatggtgaaaccccatctctactaaaaatacaaaaaaattagccgggcatggtggcagacgcctgtaatcccatctacttgggaggctgaggcagaaaaattgcttgaacctgggaggcagaggtttcagtgagcactccagcctgggcaaaaagagtgagactctgtctcaaaagaaaagaaaagaaaaaaaaagaaatgcctatcacaaagagttcaataatgacgaatgtaggtgctcagattggataaccttaatgaatgtatattctttatgggataataagatgacccctggaaagaataaggatttgtttttaatagtagaaataaatataatacaaaggagcaatttatataaagatgacaagggtattgtttctttgaagtttttttttttttttgctactgatatgtaagatttatcgtggttttcagtggtgttcttaagttttctaaattgtgtctggaaaatctcatctaggatctgaggatagtggatggaaatggaagtgcctgggtctttggaccttcattcacttcaaccagaacaagttcatttccatttgtcttataaatagagcttctatttaagctttttctggatgagaaagttccaaaacaaaaacataatctgaaaatatgttagataaaactgctcaaaagaatgctgttcgtaatgacttatggagggaaacttatttagaaatcatagcatgtagacttgtaaattttggaatgttattcaaatacaatgtataaaaaagtaagcagtcttactgggattttctaggactaggactagaaagactagatccatccgtagtgaaaaatgcaaatttgactaagttgctcttcctcttctctgtaagaataaagaggccgggtggagtggctcacgcctgtaatcccagcactttgggaagccaaagtggcggaccacctgaggtcaggagttcgagatcagcctgaccaacatggagaaaccctgtctctactaaaaatataaaattagccaggcatggtgccacatgcctgtaatcccagctactcgagaggctgaggcaggagaattgctgatcctgggaggcagaggttgcagtgagccgatatcatgccattacaccccagcctgggcaacaagagcgaaactccgtctcaaagaaaaggaagaacttcagggtgatgaaattcaggattgatcctcctgctagagggataggggttctcaatcctactgaatcttgagagttggtctcggtttgctacaaaggatctgttcatgctgtagacttctagggtgtcctagaactcaactgatccagtttgaaagatgaacttagactgccacctctaattttcaccccgttttctaaaatcctataatatatctattttaagaaactgtctgttgaaaagtataccatggatttaattggagcttttattatttgcgtcctaaaagagcacattaattggaaattgccctagttcagagaagttggaatgtgaagagagagcttgtgaaattctttgttctttcttaatttcttcaaccagtagtattgagcatctgctgctatgtgccagagatttccgagtccttgggggctatagtagtgggcttatttgtatccattcatcaagaactgcttgtggtatgaaatctgatcttcctgatcctgagtaaaatgatgtctccttttctctgctcttgatttacatataggcaatccatacattttggtatgtacttgccctttgattttctagtatgccctgttagttttggtgtcctgttgagtgtgtttgccacctaagggtgagggctccctctgatacttcttttagagtcctcatggggcccaagcatagtactgagtagtaaagtaggtactgtttgtgcttcgtttatttcctgttaaaatttagcttgttacttttaatttttgtgggtggacagtcctacaggtaaattttatttgctctcctgtttaataatggcagaatatttgaagaccgtggaaaatacttaaaatgataagttaaagcattttgccaaatggtatgattagtatgttacccatttgattattgtgtctgcataggagacttcctggaagaatgcatagcaaaataatggtggttatttcagggtagtaccatttgattatttttgtttcattcccccccccccatatttctatggttaaacgtaattttaaagtcaaagtgaaaatcctctaaaacattttaccccttgtgttttttttttctttttacattcctagtgaagtaggttatcttaaaggtaatgcttttattttccataggagggatgtttctattgagaaaatatagtattgaaattatcatccatgaggtcaggagttcaagaccagcctggccaatatggcgaaaccctgtctctgctaaaaaatacaaaaattagccaggcgtggtggcgcgtgcctgtaatcccagctacttgggaggctgaggcaggagaatcatttgagccctggaggcagaggttgcagtgagctgagatcctgccactgcactccagcctgggcgacgagagaagcctctgtctgagaaaaacaaacaaacaaacaaacaaaagaagctattatccagaacgctgatttgtaaagataactttatctatcttggtcataaattcaacagctaaaaattcatttgtatcctttcatatgttctgtttcttactccaaaagatattaagaaaaatgctgaattatcaaggtctccagcgagtgaaaatcatagcaagtgataatctctgggagtccatctctgcatccatgctccttgatgccgaactcttcaaggtggttgatgttatagggtaaggcatgttttacttggaaaactagcagtttctgattgcttgctctgtgtattgactatctttttcttgccttctccccatttgattacattctcagaaggtagctctcctgtattcacttacctgaagcatgcatggctcatagttcattattttctcttttaaatatattttaggatctttctatgacaaacatgtattgatagcttttaaaaagcatgttgatgtttggaataataaaacagggctttgttttagattaaggggcagagtaatacctgtatttaattttagaaattataaaggcaaagttgtgaaattagtttcaaactctcagatattctgtggttggaagttcttgcatgaacacttttgtaaatggttcattgtgatcactgacaataacttttgtcatgcctccttagtagtatagttttgatgcctactctttattccatttctgccttttagcactctgggccctgacctcattgggttcattttttttaaaaagtgaatttacattttttctaccatgactcaggatataaacatttgaaaaataggatatgtatgtttgtgtgtgtgtgtgtgtgtatgtatgtgtgtagaatttgttctttatccagtgtgaagactgattgatctctccatgtgctttatttttttaatgaagaattttgaatgtacacaaaaataggcagaataatacaatgaatatctatgttcttatcactcaacctcttgaactgtgaatccatgaccaattcttcatccatgcgtctatctactcctcttcctttcctgcctacattactttgaaagaaatcccagacattatttcttccataaaaatattactgtgtatgtgtctccaaagataaggattatttttctacttaccataaacaataccattattatacctaaaatgtaatagtttttgatattaaatatccattattatcttatagttttatttgattgaatctagatccatttaaaattcatgcattgtgattggttgatatttaaatctattctaatctttatgttcttgctctttttctttcttttaatttgttgaagaacggggttgtttgtcttacaaactttgtgtcagtctggattttactgatttcaacccctacagtttaatataacttgctcatctatcctttttcaatggtttttgaaattggtagtttaggttagatttaggttaggttagatttaggcttaatttttttttgcaagataaaatttcttaattatatttaaacattttatacattgaaattaaaatgaaagttttgctgttgttaaagctttcataaatagttgaagtcttgaaggaaaacaaagttgtgttaatcttaaatatattttcttataaaaatattgcatgaaaatatgggttttactgtatcttcatgaaggacttggatatgtacttcattttttattgatataggtattttaatgtaatgaattttcctctgagtactgctttagttttatctcatagggctgttttatcattaatttctaattttattgcactgtggccatttaataccaaatgtattatttacatttttttgggaaatttctcaggagcttattaaaaaaaaatctgaaaaaataccttcgcttttttcttgactatctcaagagcatattttgatttattaagatgtattctttattaggatacagaattgagtttatatataaccttttggttatattgttcaggtattttgtatcttaacgattttgtccacttgaactgttcagggctacccaggtgtgtttgtttccttatgttagtggggtctatttctcctttcaatcttaggcagtttttgctgtgtggaagcttctgctttgttatttggtacgtaaatactggaagcttctgctttgttatttggtatgtaaatactgatgaatgttttatcttcattatgatttatttcttatcattagaaaatgccattctttgtctcgtttaaagcttcttggcctgaattctgctttctgtgtaactaagagatctatgctttcttttcattaggatttgcctaatatatttttgcccttttattctttacctttcaaggccgttttcttttatgtgcattgcttgcatatagcatagagttagattttgcttttttaaagttcctctgaaaatctttatattttaatgaatgagttaaactcatttttaaatataactgatgtttgtgttttctatactactatattgtcttttgttattgaatgatttatactatccatgtactaatacaagctattctgctatgtgatttgtttactttgcacttatttaaggaggtgtttcttttgttatttagcaaggtttggtttttgttctgtcaattacatttatactgatttataccagtattttcaactgagaataattttgcctcccagacggacatttggcaatgcctggaaatatttttaattgccacaaataggtagggcggtgccactggaatccgatggatggaggccacgaatgtttctaaacatcctttagtacacaggatagttttcccataacaaaaaatgatccagcccaaaatgttaatagtgctgaggttgaggaactgcttcatactaatactcttggtttcttcttcgtttagttattgtctgttggtttactatgagcaatactaaaattatttgataacttcttcctccctttttctcccctaccgtggaattttaattaccagaattatcttagttttaatttttgtactcttacatgaacttaagcttctactatattgatttgacagctacaagttttaactgtttactcccaaataatctgcaaacttagtttacatttcaccttctttccttcttgtcctacttcatgtagctgtattagttgtactttagccaagtgtgtaatagttataatttaattactatttcttttaatctcactctaccattaaacatattaaatgctcaccttcaagtcctttgccaaagtttctccctcattttcttggatatcagaagtgtaattatctattaaatgtctcagaaagtgctaatggaaacaatatttcttgatgtgttcagatgtttgttgatgtttatctatgacctttatacttgaaggacagtttgactggatataatccttttttaattctcaaatatgtgtaaatatatcataaaatttgctccattagttatttacataaaatgttgctattgagaattttgactccagagatatttccttttccttataagtaacttgacacaattcctttatgcccaaagaatatttttattcatctttaaagtttagttgttgtatacactttaccatttccagatatatagtatatgctctcttaatgtctatatttaagtattttcttatttcagtaaggtttacttaagttataagttaaatcattattccactccattactttggttttctttttagaagcaccagttatactttggtcttatttgcatatgcctttattttgtatttctctgaatttttctctatctctttatttatgttttctattattttatccttactattctatattcctcactgtgttttccacagtgtctgttctgtcttatgttccttctagtttagccttcatttccaaagtgtgtttttgaaaataattcttctataattctctcattttaatttcctatattgctaacaattcatctttaaaatttttaattgaagtacagcatacatacatacatatataaaagtacaaaaatcatcggataatagcttaatgaattatcacaaagtgaacgtacctatgtaacagccacccagaaaattatcagtgcccaagaagcttggttactgatatctcctcttggaaagatttttccttggaaatctttccaataattaagctctctttttgccttaaaggtaactactaatctgacctctgacaccatggactaattttgccggtttaaaaactttatttaaatggcatcctatagtagctgttatttcagccaatattatataaatttgtgagattaatgcatgttgttatatatagaggtagttcatatttattgtttagcatccaattgttggatgctaaatgtagcataccacaacttatctgtgtattattttttaatggtcatttagactgtttccaattttgggctattggaattttgttcaggagatatttcttggctcacatcttcataggaagactattcctccctgcctcattcatgttgtgcttggcctgtgctatatctgcagatttttgttttacagttacagtactttctagggtctgtttctgctgggccccattcttcttagtgactgaaagttgttctccctcaaacaaagcgttcctgccttattcaacttggattctacttcaaacagcttattttcatgttgaagctctaccattcctgattatttgctaccttctcctgaaattgttattgcttaaacctgtattgttcaatacagtagccactagacacatatgtttaggaagcacttgaaatgtggctagtttgagtttaggtgtgtaataagtataaaatatacactgggttttgaaaattgaatataaaaatattatttacaattgttttacactgattacatgttaagtgataatattttggatatattgggttaaatatatcattaaaattatgttctccatgtttttctgctttgtaaattcaattaaattttttccatttatgtgttttattgtggtaaagacctttgctggtttttaatgtggctgctagacaacttaaaattgtctatgtgtggttcatatcatatttctaccagacagatctggtttgaactgttacagtattgggtttgatctcctaatgaattcactgttttgagcattgacccctaacttcaagcctgtgaagatgttcccatcttcctgagttggtcttctatgctcccccttagggtagggtctactccttttgtgtgagtaccggccagtcccctttcacttctagtttccatataccatctgctgatcctgggccatttctgatgctgcgaggctcctggggagagtccctgtcacctggtttgatggcagtgttatctgtgagtttttcctttcccttatctggttggtcagtttggtttcaggaggagtactgaggagcttcagaaactgggctgctgtcatgttctgccttggccagaaattctaattttttaaagtacaaatatgttcctctgttaggataaactataaagttggtttactttcattgatcttaattttgtctgttattgaagtttgaaaaataatgctgtgaagtgatagagaatgtttgcctacttatatacattaaaaatttatattctttttttttttttttttttttgagacagagtctcactctgtcctctgtcgcccaggctggagtgcagtggcgcaatctcggctcactgcaagctttgcctcccaggttcatgccattctcctgcctcagcctcccaagtagctgggactacaggcacacacctccacgcctggctaatttttttttttttttgtatttttagtagagacagggtttcaccatgttagccaggatggtctcaatctcctgacctcgtgatccgcccgccttggcctcccaataaaaatttatattcttaaagagcctttacattttgttgcactagtaataaatctatacattaagaaagacccagattttagtattagttctgcctttctttgctcatatcatgtaataaatcatttgggttttgaatgtggtaacagtttcatcattttctgaatgaaggatatatcacctattcctataacttcaataaagttactttttcattttataaatataatatgctcattatagaaaatttggaaaatgtagaaaagtataaaaatagaatttcctcataatcctaacatctactgattattggtaacatgctagcatattactttacagtgttttctttaatatagaaatatattttaaccaaatacaccaaacatgcatttggcaactagacaactggatgacaactagatgagtattaaaaattaacatttggctgaggtaccaaagctgaatttcatggaaatagaatggagttgtgggatagaagaataaatctaaagtgtaattttttgaatttatattatttaaaagactagtagccagatttttcaggttgggcgttatagttccagaacaatgattgcttaaccctgttagatgctagatttctgttggtatctttgtagtgtagatttgcaatattgaatagatgcctgctttcacctgagtttagtgactcagtaaaatcttagtggaacctcatttttctctaatacttctttttatgttctccagtatatattgtatattattttcttactcatgaaatcctgggatgccaaattgatattgtgccctaattcatcttcactaggtataaagaattaccaaataggattttttcctaaaagatttgtgacctaaaagggaattaaataactaaaaagtaaaacaagtattcacaatcattcttttgatgttataaatactactacaccaaactacaaagattagaattatgatataacttaatctccattattttgcttgcattgttttttgtaaataatttttaaactaaaaagtagatgctcttattcctacagttatttagctagtgtgctctcttattggattgtcaatctattttctattttacatttaaaatttattgtttttattcctataatcagtgtcttccacaatcatcattatgggagtattttactcttgcagtaatgaatatgcatttatacttccaccaactgactcccctcccatcgaatgatagagtgaaggaggcattcattttctggggcagtttctcacctgctgcactattgatattttcaatggataatttttttgttgtaggggttggtcctgtgcattgtaggatgtttagcagcatttttggcctctcttctctagatgctagtagcaaatatccctgaccccaggtgggacggttgaaaaaaatgtctacagatagtgccaaatattccctccagggacaaaaatcatctgggttgagaaccgccactgctctgatacagtaatttagttttcccaaggtagcttattctttttattcaagaaataaccatgtgtgggttttgttttttgtttttggcctgggagtaaatgccaagctatctttctgtgttctaaggacaggagtagtggggagagtactactttatataaaggtttcactagtcttatttttggcctcctcctcactcgtttactattgccccaagctccttagcttcccctgggaagtctgaatcttatctttacttcattctcctcttggagtgttctaggctgtggccctctctgctacctccatccttcaacatgcttccatccatcttgtgagctccagaaatagattgaaatttcttatctattgatgattttccttcctatcctgtatgctgttgtaggtttatccccttttgttttctttgctgtcattttaatggcatgctgagacaaaagggcataaagcagatgcttagattcattatctacctggaagctacccaactgttttaaaatagaaaaccttggagaagactcgtatttttatatactcaacaaatctatacgtatataagtgccacgtcgtgaccttttttcattgacttccaccctttttttttctagggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttcgtaagttattaaaaaccttttagagttcttatcaaaaaaaatttaaaaacataagagttagaaaaaaatggaattccttattcttccagcctagattcaatgattgtaaacattttgccttgttagcgtcatctatttgtatacctatacctaatctatatctaattttctatatttgaatatagtctatattaaataaagtcaggtttattgaggtataatttatatgtagcaaaatacatgcagctctctgatttttgacaagctacatgtatttttaataattataaagtaaatagtatatgtaaggacactttatctctaaatattttagcatgtgtctccaaaacataaggatattcttttacatgatcacagtatcatgttttcatacatgagagtgtttttaattctcagtctatattcagattttcctaattgtttcccaaaaatgtcatttgtagcttttttaaagaaaaggaatagtcaagcacacacatattgcatttaaaagttacacccctcaagtctcctttaatctagagtggtttccttattcctcatttttgatgacagtgatctgttgaaaagaccaggctggttgtgttgtggactgtctgcttcccagcctgtctgattgattcctcatggcatcacttgatatgtgtaattgtttgtttaaaaaacagatgttcttaagggagaacacaactatttttgttcctaagggaagcatttcttaaatgctttgaaaaacacttgaattgtgaatagattccaattagctttttttaaacaatgataaatagaacaaaaacaaaccaatatttatgtatttgttgtgatgttaatgtgggttgctgtatattgtatttgttctttttcttctctttgtgaaagaaaagacacttaggagagtttggttataacttaatttggtcttaaaggtaaggcatcttcatggcagagaatttagaaaactgaagataggtacaaagaaagaagcaaaatcacctacagtcttatgatccagagctaaccatcctaaacaattttagtgaatgtcctcctgttttatattggcatgtatacattttaaatacaaaattgagaccatactatagaatctgtttaaaaaactgcttttcacttgagacgacattaggaactttttctcacatttacctatatttctacttcatcatttttaatgcattttaaaatattttgttacataaagcaccatttcccagacttgccttaagaagcacccgagacactcgttgttataccttctccttggcagctgcccagacattgtgaatcagaatctacagggaaggctcctggtattctgtccatctagtcagtgccctcaagtgattctgatgccacacaagttgggaaacactgatgtggaaaatatattattgtttattgaatattctcctcttttagaattggaagttgtctctgttttaattaatagctttgtacaaactgaaatgatcaattgtatacaaatatctttgtatatgcccatgactattttcttaggctgtattcttagaaatggaatggtcagaaatacatagattttgaagggttttgtatgtattttacaaaatgccctccagaaagcttgtcttgagttatacatctatcactagccagaaaggataccacacatcttgcaaaccatgggcaaaattataagaacttaaaatattcactagtagtaaggtgttttgaaaattaggactattatttctactttgtactgatagaattagaaggctttgatttgctaagaatgtcagtctcttttttttatactggatgaggacttgataggaaaaataaaattctgtgggtaagctttgttttttttaatctgtgagggacccaacaataccaagttcaataacttcccttttgtccttggatttcctgagaagcagagagtcaaagttttagggtttagcacctgctctggactgttagggcctgatcatctgagaaagaatgggccacaaagcagatcagcaattagatccaattactacttatagatgaagtggaatcatatttaatagcaatactacggcccagaccttgttccatactcttcctatgcattagtacatttaatccttacaaactcacgtgagagagatataattattatcctcattttacagagaggttaagtggtgaaaccatggtttaaacccaggcagtctgactccaataattctcaattgtaaaactttggaacagttcagagtcaagttcataaaaattatgtcataaaactggggcattaagaaggctgactgttgaaaggaaagtaggtatgcacaaagcctttatttgtatttgactcaaatttgtgatgtgttgggtattggtaaggcatgattcgtcttctggctataccacagttcagtaaaaatttgcacataatacatttgtattttttatcatgtgattcaccattaaaaatattacaatgtaccccacactggatttttcaaaatgtgaataaatttagacaacttatattttcttattttgggtgatccttttattgtcatttatgtagatgtgtattactatgataaagtctttttactccaggtttttagacatttacatttttatcacaagttgtcttggtgtttcttttttatcaaatcttttagcacaatcgcatggaatttagtggctagttactatgaacagttgccttatgggagatgcgggttgatgacggcccaagagccatggagtgggcactacgtggtagaatctcctgtctgggtatcaggtatggttcagttccatctctcactccctaaattcttctctaagagacaaagcagaaaaaaacttagagaagattatataaactgtgtgtctatgcgtgttttaagtatagatttaagttttaagcaagatttgccagtgttttataagaatattttgggtaactagactactctctgattattctaagaccaggcttttagaaaagtgtaggagaggagggggagagagaggaaaaggaggagctgtgtagtgatagagacacaaataaataatcatctaaggatataattacaaatgatgataattgctaataagattatgtatttataaacagagtagaagtcttaagattagctttgaagacattttgttctcttatattaatagagtttcaattacaatcgtatgctagcaaaatcaaagggagatgattaaaaatactgtattattgaatcatcaaatgaataagtaaatatgaaagttatgtgaaatatggctttatattgtcccctaaatctgtgaaatgtgggttgtgaaaaggtaaatttcaaaataggtaacaatgtaaagctcaaaagattttaaaagtgagcacgtactgaagattttatgttactcatatgatatgaaggatcctggcagatagatggtagatgttagaaacagttgaaatgaaaagtcaacatagcacaaattttcgtagtgtaagggaattggagatgaattgtcaatggaggcaaattgggtttcccacaacagggaagaaattaattaaatttctaccagacaagacataatttacatagctcagagacaatgaacagggctatagataatacatccgtttttattgaaacacaaaagttttactacagtatcattcattagtcacaagggaaattgagattatgcagggatggatggcatagtgtcactttttcatgaggagataataaccatactaatagtgattatattttaaacaaagtaacaaaatctattgctgaataatgttgaaacttttctgcagtttttttgtaaaagattataaacatttattaccattttgttttaaaattctaacaatctttctaaaaagctaatttctttaaaggtaaaatgctttcagaagaaaattatgaatttggagtgaatttgtttttattttaaacttaaatttggtggttttcccttttagttgtgctctcctaagacagatttgtaatcatattaatcatgtaatcatgatattattctaaactccttaaattgtcctccaaaaaatataagaaaattaaggttagacttgtatattggacttgtatattctaatattgagaattatatgagaaaattaaggttagacttgtatattggacttgtatattctaatattgagaattatatgagaaaattaaggttagacttgtatatcagcgccttgaatgttgaaattgttggccccacattatctagatgaactaatgtactcttaattttgtgatttttccaagggttgggacatggtatattgcttagtgcattttcaggatgagcttaggaggtgaccaataaatgtacatgtggtggaaataaatatgtttgaaaccataaagttagtttctgaaattcattattaactttttaaacctttttttggtagctattttaggatggattaaatagtgatgaaccaagtttggggggggaataactattttattcttaaaaaaaagactgatcatattcttgaactgacaggttcatttatttttacccatcattccaggaatcttcttgcaattgtaccatttatctagattaattatttaaaaatttaaacatgaggttgacggatatattcctgcaaaatagaaaatagcttgtttggatgaatcagactcaaattgatatacagctttttttttttcccaaaagaaatactattattaccatttttgtcttatttggaactttctgtttttctatagctcataccactcagtttactcaacctggctggtattacctgaagacagttggccatttagagaaaggaggaagctacgtagctctgactgatggcttagggaacctcaccatcatcattgaaaccatggtaaacttttgttgttgctattggattaactcacttctttactattggaaaaataaaatataaaactgaatacttttgttttacatgtaaatacataagcatacagacagatgccaagatcttatggctttcatttaaaaaattttagccatgagtcgtaaaacatagcacacaactcactgatttgtacaaaatagttggctctcatcttttctccactttgttcctggcagttgggataaaattaaggttacctgtgtaccaatatttgtggagacgaccttcacgaccttcccttgccctgatatgtatatggaggctgtggctttttcctttttcatcctcaggttgttttggggagaccttaagtctgttgagagcaacgagcttaaaattcaagtgattgaggggcttgagtaggaagggaataggtctgacaggtggacagaggcatgggaggaggtaggggcttgaaagcagacatatcaaggattcaagggaactgaatgaaagaatgaaggtgaaaaaacatggaagcagaagcagaagccagtggagagaagaagaagtctgagaggtgccagtgtggggagatctcaagcttcccaaagaggtcaatgaagttccaacaagaaggaggtagacagaataggaagtgcatatagtcagcagggctttgtgaagaaggatttctggcaactaagttcccatgggagaagcaagatccaaaacagagaacagagtagccttaaaaaaatggtgtgtgtgtgtgtgtgtgtgtgtgtgtgtgtgtgtgtatcatatcaggttctgaatgtcagcctacagtttggccaactcctgaccatagactcttaaaaaacaaattctttcaaatatcctactatcaggtttgagccaggacaaacagtaaatattcctggcagtattgaccttttcaaaccaaaggtgtctattaagtgactcacaacacaaaccaataagccttttatgtcttatcgtggatgaagaggatcctcaaaagagggtgtaaaaagatgcagccctcccagaatctacacttcatcgtagtcaaaaggttgagaagtgatcctccaaagacctagaaccactcccaaggatagtcaaaagaaagacccagataacctccctactccccactccctgtcagagctagcgatagttggtaaactggctgcaaatagggtgcgaatcacatttttgtctggttatattcttggggcccccaacttgaagttggctgcctgcatacacaaaactgacagctcacacatccctaacaggtgggaagtcaagccaggttctcagtacacaaaatgagacaaataggaaagcaatagctgaccctgggaaggaagggatctacaggtaatgagcacccaaaactaaatttatacaggaatcacaaaccaaacgaatgtttttcttctgcgaatctgcatttggagaggaagggatgaggaggtttttgtttgtttgtttgtttgtttaattgtcttctctcgatcgggtacttcaggcagagatccagaagagcaggccttggtgagaattcttaacctttctgccacctttttgtcagtgtctcaggatctcatctgcaggctcttagagtgagtaggcatctcatcttcttcaccagaaactgtcttcagagataaggaaaatagggagagcacctgttgagtgagggtcttatgacctgcttcagaggagaaaggagaaggtcagagagtaaacttcctgcttctacatttttctcaaattatttcactttaaaatatttgcggggagtgtgtcttgaaccccatcatggctgttatgactaatggtgtggattagcatatgtgtacaagtttttctgtgaacgtgttttcagttctcttgggtatgtatgtaggagtggaattgctgggtcacatggtaactctgtctttaggattttgaggaactaccaaattgttttccaaagttactgcaccattttacattgccaccagcagttttatgaaacttacaattctccacatcctccctaacagttcttactgtccatgcctttgattatagccatcctagtgaatgtgaagtgctatgttattgtagttcgatatgcattttcctagggactaatgatgtggggatcttttcatgtgcttattggctagtagtatatcttctttggagaaatgtctatttaaactctgcccatttttaaattgggatatttgtgtttttattattgagtcataagtgttctttgttctatataaaaattccttatcagaaatataatttgcagatattttctccctttgtatgggttgtctttcattttcttaatggtaccctttgaattaaaaaaagttttaaattgtgatgaagcccactttgttttctcttttgtttcttgtgcttttggtgtcatatctaagaagctattgcctaattcaaggttctgaagatttatatttatgtattcctttaagagttttagagttttaaatcttaaatttaggtttttggtccattttctttcttaactggggttatatgtgtgtccaacttgattctcttgcattttaatatccagttgtccctgcactattttttgaaaagactactcctttttcattgaattgtcttggcatccttgttgaaaatcaattggcaataaatttgagggtttatttctagaacctcaatttttttctgttgacctatatatctgtcctgacgtgagcaccacactgtcttaggtactgtagctgtctgataaattttgaagtgaggaaatgtgagtatttcaactttgtcatatttttattttttattgacacagggtacaatttgatgttttgatacatacatgtggtataatggtcaaatcagggtatgcccatcacctcatgaatttatcattcctttgtgatgaaagcattcaaaagcctctcttctagctgttttgtaatacacaaaaccttactgttaaccgtcttcaccctagtgtgcaagaaaacaccagaacttacacctcctgtccaatagttactttgtacctgttgaccgacctcttcctgtccttcccttcccagccccaccctagtgtctggtaaccactgttctactctctgcatctgtgatatcaacttacacctcctgtccaatagttactttgtacccgttgaccgacctcttcctgtccttcccttcccagccccaccccagtgtctggtaaccactgttctactttctgcatctgtgatatcaactcttctttttttttaattctacatgtaagtgtgatcatgaggtatttgtcttattgtgtctggcttatttcacttaacatcatatcctccatattcctccatttgttgcaaatatcaggatttcattctatgactaatagtactccattgtgtatatatatatcacattttctttattcatgcattcattgttgaacactcaggttgattccatatcttggctattgtaaatagtgttttaataaacatgggagtgcagatacctctttaacgtatatattttattttggggggatatatacacagtagtgggattactggatcatatggtagttctacttttaatttttttttttttttttgaggcagaatcttactctgcacttccaggctggagtacagtggtgcaatcttggctcgctgcaacctctgcctcctgggttcaagtgattcttctgcctcagcctcccaagtggctgggattacaggcgtctgccaccacacctggctcatttttgtatttttagtagagacggggtttcaccgtgttggccaggctggtctcaaactcctgacctcaagtgatctgcccgcctcagcctcccaaaatgctgggattatgggcgtgagccaccacgtgccccgcctatttttaattttttaggaatctccacactgttttttatagtggctgtaccaatttacaaccctaacaacatgaagtaagtatttctttttttccacatcctcaccaacacttgttttcttttgtttttttggtaatagccattctaagtagagggaagtgatatcccattgtggttttgatttgcatttccctgatgattagtgatgttgagtattttttcatgtacccattggccatttgtatgtcttcttctgagaaatgtctattacagtcttttgcccaattttaaactgggctattttgttgtcgttgtttaagttctttacatagtctagatattaaccccttgtctcatgtataatttgcaaatatttcctcccattttgtaggctgttttactttgtttcttttgctgtgcaaaagcttttcagtttgatgtcatcccctttgtctatttttgcgttgtctgtgcttttgaggtcttatttaaaaaattcttgcccagctcattgtcataaagcactttccctttgttttttttctagttttatagtttcaggttttatatttaagtatgtaatcaattttgagttgactgtgtatattgtgagagacaggagtccagtttcgttcttctgcatggggctatccatttttcccagtgctgtttatggaagagactgtcctttttcctagcgtgttcttggcacctttgttgaaaattagttggtcatagggcatgaatttatttctggactttctattctgttccattggtctgtgtgcctgcttttagacaaaaccatgctgttttattaatcgttactatagccttttagtatatgttgaagtcaggtagtgtgatgccttcagctttgttctttttgctcagggttgcattgactgtttgtggtcttttgtgttcctatataaattttatggttgtgttttctatttatgtgaagaatgtccttggcattttgatacagattgcattaaatctgtagattgctttgggtaatatggctgtgttaacaatattaattattcactatatttttgtgagttttttttagtgattattctggggcttaccatatacatcttaacttattggactcacttcagatttaaactaaccgaattacagtagattatgctgaattcccttgttgctctgttccctttctccttttgttctattattagcacacatgtcacaacactgcgtgctgcgaactcaataggacattgttactttatacataaatttatatgtttttaaaccagtaacatgctgttttggttactatagccttgtagtataatttgaagttagataatgtgatacctccagattgttctttttgtttaggattgctttggctgtttggactcttttttggttccatatgaattttaggattgttttttctaattctgtgaaagatgatgttggtattttgataggaattacactgaatatgtagattgctttgggctttgtggtctcattttcacaatattgattcttccaatccatgagcatgggatgtatttccatgtgtttgcatcatctattatttctttcagccatgttttgtataatagttctccttttagaactattggttcttggttaagtatattcttatatgtttttgtagctattctaaaagagattgagttattggtttgattctcagttttgtcattattggtatatagcagtgctgctgatttatatacattatttgtgtacattgattttgtaacttgaaactttactgaattcatttatcagatctagcagtcatgtatcaacagagcagaatacagaacccaaaaataaagccaaatacttaaaaccaactgatctttgacaaagcattcaaaaatataaatttggggaaaggacatcctatttaataaatggttctgggaaaattggatagcaacatatagaataatgaaactgcatccctacctctcacctcaccgtatacagaaattaactcaagatggattaaaggcttcaatctaagacctgaaaccataaaaattctagaagaaaatctaggaaaaattcttctgtacattggcctaggcaaataatttataactaagaccccaaaagcaaatgcaacaaaaccaaaataaataaatgggacctaattaaactaaaaagcttctgcaaagcaaagaatcattggagtaaacagacaacccacagaatgggagaagacatttacaaattatgcatctgacaaaagactagcatccagaatctataaggaactcaaaccagcaagaaaaacacaaatcccattaaaaagtggcaggtgacatgaatagacatttcttaaaagaagatatgtctatagccagaaaaacagttaaaaaaaatgctcaacatcactaatcatcagagaaatgcaaattagaaccacaacgagataccaccttactccagccagaatggccattaagaaacatcaaaaaacaatagatgttggcatacatgtggtgaaaagagaatgcttatccactgctggtgagaatgaagttagtacaacctatatggaaaacaatgtggagatttatcaaagaactaaattgattgatctgccattcattcctgcaatcctactactggatatctacccaaaagaaaagaagtcactgtatcagaaagtcacctgcacacatatgtttatgtagcacaattcacaattgaaacatatggaatcaacctaagtgcccatcaactgatgagtggataaaggaaatatatatataccatatatatatggtgtgtgtgtgtgtgtgtgtgtgtgtgtatatatatatggtgtgtgtgtatatatatatatatggtgcgtgtatatatatatggtgtatgtatatacatatacacacacacatcatgaaatactcttcagcatagaaagaatgaaataatgcctatttctttgaatgtctcattttttgtgtgtgttgttggaaactggaccttatatataatatatggtagcaactcgtatataatatatgctatcaactctgggcattgatcctctcccccttgaggcttgttgttgtttatttatttacttagtgatttgctggagtattttagttaactctgttccctccttcttcccctccacacactgtaaagcctgaaatgttgctccttggagaatgtggctttgggcatatccacagtcaccctgggatttgtttttccaggactctgtctggttccttgatcacacctcactgtaagttacactaattgctggtggatttctgtattgttttaaacaatgccctggggacttaaattgttccaaagactgatccaattaaattccagctcattttcaggggtggtttgaagttagtgttttagttttcttctgaccacaggagatttttttttttaaactgtcacttttttttttcatttcatcataaatttattttcaggcagtatgataatctattaatactcggcatactctgaacttacagaataagtaccactctatacttcctcattaatgactatcattttacatgagcttcttctacaatcacagtgagagaacagattgctacatgtttgctaaatacattcagtaaggcactcaaatcctagacacgaactaaccacagaacgctcttccccgctttaataaattgaaacatgatctcatttccttcgttttcaatgctttttatagaaagacacgcttgtcttgaacttgtctaaacagaggtttatataaactaatccattatcatgtatagttgtaatcaaggaaatgatttcacattgacggttttttaggtagggataagtaaaagcactgcagcagtttctgagggaatgtcttccctgtggttcctcatacttagtacaatgcctggaacgtagcagggactaaatacagtgaacaaatgggcaaacctttaattcccagggatctgctacatattgccttgactggtagatcatttctccagaagaaaggaagaaaccaaaaaacaaaaataatctttttaaacctcacaggattttcttagaaaaaagttttaattgaaattctctttgtaaaatgtatttaataaaaaatccaaagcaaaaaccctatcgtttatttacttcaaaagacaaatcatttcagtacttcttccttgaaatgcctgccatttcttcctctggcctcagaaaagggcatcggctccatgctttacagtgtcaggataaaaatccaggagggagaaatcttgttgtaatggatagctgctttcatctaacacaaaaaggctctgaatctttgatacacaaggttctgcgctgactgccgacaaggagtgtaacaggtctgccatgaccatcccataggtgatctctgaggaagtaactatcactctgttgaggcagtctgcaaaaatgttgagaagaatcttctctatcagctttgagtctacacggatgtaaacatcatgtcttccatcaactacagtcattaaagctggcctatagtatattttcttcatagtaaatggcaagcagctaaaacattgtttgtagatcctgttctcatctgtttctagttccaatccatattttgcgcagccagtatatatgatgttgggaagagaagaaaagaaatactcttcagagaactgtgagcatttagagctatcttctgagctgccgtaataggaaatgacagctctgaaatctgggctttaattagaaccactcctgaacatttatcctctaggtgggttgctaagtctgatatcttccaaaaggaaggtgcacttttttgaaattttgctttaaatgtaattgcccttacatcatcatcaaacaagcactcacaggatgaccaaggcattgtatgcgattttaggttttctagtgtgtaattgcgctgaacaaaaagatatttaaattcccaaatataaccttttttcctttgcagttgagggtaccaggctgctccaggactccataatacaagcacataatgttgatcttgggcctgttccactgttaacataactttttctgcttctgtcctctataactgtatactgcctctgtcagtatagtgaaatcaacaactcttagtattgtgtggactaatacatcaggctgaaggtgctccaattctataaagtctatactgttcaccctctgaggctgcctcggaggaagatctctgaggtaggaatgttttgaggacacctgtgccagtaggtcttgaagtacaacatcactaactacactggaatattcttcaggctgaatagatgaataactcccaagatttaataactgactgctaaatgttgattgtagtactgtctcgccaacccattggtcctcatgaataacaacatctgcgagtaaaattatatctccaagaaacactgtatatgcccaaaatgctgcagtcctctacagaaaaaccttcttagtttctgattgatcaattactgtaactgttgctaaaggcactttagagccagaatttggtccgaattttatgtttatttccttcacatgacatggagatagcaccatgactaaacaatcatacttctggcttttagaatcacagttttttattaatgactttttttaatacccttaaattcagacacattcctctgatccatttctacaacagaatctcctgcattagaaatcaacttcattttcttagctacttgaaggactctagatagagcttcagactggcccactttatcttcagaggtgcagcttcttttaatagcacttttgtggaaggtgtttagttgggaacacagtattcctgagctacacaactcaatacgtatctcatttggtggcagttcatcttcagaactgaaaagttcttgagatcctgtattttcttcaggacctttgtcagagtttatgtgaatgtggctattttctgttttaggaaaaacaggactaaaatgttcaagagaatatgcttggttttgtccactttcatatgcttctgtaaaatcatcaagttgaatggaattctcttcagatattcttatcttcccgtaacttgcctttggttcagtctccatgtttacattccctttatttataggactccgccctttatctttcttttgagctaaaaaagcaacctggctggaggtaattatacagagaaattccgtatcagttgacattttaaggtctgagaccttcctaactgctgcttcagacttcagaccttggcttatctactgtgttcaaggaaaataatcccaaacactggttttgtatttcatgatattctgttggcacacactctctttgtaccacttcaggccctatattaatttgtttagtactacaaaccaaatccaacatagctgcacatttgtggtctaactgaaacaaatttgagtgaaagttctgaccacagatatctgactgatgtttaggctgttcatctataattttattttcactgagaagcttttgatacttttcagttaaatgcagaactatgctttcaaatccacatatttgcatattagagctcgttacctcactcagtctagaggagtgaatcttctgggattctatattctgtgtttcagaaacagaatgtacaaagtaatctttcacatgaacatgtctattcatacagtttgctaagtaagaaatgaccactaagatctggagaccaatagattctgggacttcatagttttcaagatttttgtgctgtttttcatccttcagatataaagaatgttgactgtataaaagctgaatttttttccgggggtcagcaacggacattaaagaaactgtgtgttgtgatactgtcatttttagtggagcaacaggatactaggctgggtggttctcaacaggatattaggcagggttgtggtttagcttatgcctatagtgaagccactggtttcttttttcttttcaccaaaacctccattattttttagaacaacattagtcttaaacctctctatgctctgtgtcaaatatcaattcctttaagaaaaggtttgaagctatttcatgccttgcctctccccctaggtaaatctctaatctctagtaatgtcacctttcttattgttgaagtgtatgttttctcttaacctgattttttattagtctggctagaagtttttcaactgtattgatcttctcgaagaatcagcttttggttttattattttcttgtggtttttaaatttgtttttgtttaattcttctttgctcattattattttctttgcctattttggttttttctttatttttatttttactttttaaaaaaattttatttccacagttttttggggaacaagtggtatttggttacataagttctttagtggtgatttgtgagattttggttcacccatccccgagcagtatacattgaacccaatttgtaatcttttaaaatttgctcctatttttctagtatctcaagacagaagctgaactctcaaatcctttcttggtttctaatctaggtatttagtgctgtaaatgtcctcctaagtattgctttagtggcataccacaaattgtgatatgttgtgttttcattttcataaagctgaaaattctaatttctctttttatttttcctttgatctattgattatttagaaatttgatagtttgtaaatatttttgacttttccagaaggttttcagttattcatttctgatttaattctatagtggttaaaaaagtactttgtgtgacttgaatcttcctgtatttatgaggacttgctttatggatcagagtatggtgtagtttggtcagtgttccatgtgcgcttgaaaagaatgtgcatcctgctgttgctagatggaggcatttatagatggcatgttgtttggtagtgttgatcaaatctcttatatccttgctgattgtccatctagttgtactatcaattactaagagatggatattgaaatctctgattatgaaagtaattttttaatggtctgcaaagcctgaaatagaactgtgtactataagtattctgtgactgtggaatctcttaaagtagggattatgtctcatacttcttttgatcccagcccatagttgtgactatttagtaaacagtgatggcaatgtgagaactatgttacatatatttagctgaccttagtgtgtatttgatatctatatatactatatatacacacacccatacatatatatatatattttttacttcttacatgagaacgaaagttatatttagatgagatgtcttttcagtgaaaacatccttacttttgctttttatttgatgtattttagttggaaaacagttataacaaaaaattaatctgtatgccatatatgtctctacagtttagctacgaattcaaaatttgatccagttgaaacgccattgacctttgcatttgactaggaacatacaatacacattcagtaaatattatattataaaaaagtctttaaaaatgtgaaataaactcatatttgttatctagtatatgtaaatttctgttaatcttgggcattaactattgaactttttttcccctaaggtagcttatacatcatttggataatgtatgtgattttttttttcagagtcataaacattctaagtgcatacggccatttcttccttatttcaatgtgtcacaacaatttgccacctttgttcttaagggatcttttgtaagtaaatatgtttaactttattttagttttgatttaagaatttatatattctgtcacaggccagtagttcttaagtgaagccttatattatgaacttttaacagtttgcatatgaattgacagaggccctggtgtcttctgtcttctgacttgctttaatctagcaggacagaagccagtaggaggtaaaatgctctgtgactttgaggaacacttacaaaagtcacttgcaagaaagttgttcttggtggtagaagcattttatggtctagggaactttcaagcattgatatttacagtatactatgccaaaaatattgtttaaaagtaccagatacttgctatttctgtgaattgttaggtttgaattgacaaactgcagtaccctttctgattactaatggcataagaattgttttttaataccagaaagttattttaatttagaagttattacacaggtacagtaatgaatgtttttgaagcaaagacactgtaatttttttatcatttgccaaaattctttagtgtttagagaataaagtatttgcttgaacaatgttttcctatttttaaaaatattattatttaatatttgaggtgtttctcctgataaatagagataatattgtcattggtacattcttgctggtactgattttggaaatcctcaaagaggatgtgatgaattactcagccatgcttttttgtcttttctttacagagtgaaataccagagctacaggtatggtataccaaacttggaaaaacatccgaaagatttctttttaagcagctggattctctatgggtaattttaaagtaaattcttatattttgggtattccaacagtaaaacagtaaaagggcacagaaatgtcattaattaagaatttttatttttataagtttgtgtgtttatagatgtgtttagctcttagacatttagtttgtcttggtggatggtgacgccatcacctggtttcccaggttggaaatttaagtcccatttgagactctctgtctttcccactcaccctctgtatcccgccagtggtcaagtatagacagttgtatccacacatttctcttactcactccttattctccattaccaccgttacttcttgtttcagttcttcattatcgctctcctggatttcagaaactgcctcttgtttttccagtctgactttccaggtcacccatcacactgctacagagtgaaatgtcaaaaatgcagatctgatttttgtgaccactgtgctcagaggacctcagtgattattttcttagaagttaacattccttagtgtagcacatggccctcattatcctcccagaaggtagaagactggtcttcttcctagagatgtgtcctactaaactggcctctcttcacatactaaacttacatttttcaaagcatagcatgcctgtttatttacctctgtgactttgcacatactgtgttcttcacctagaatggcctctcctcatctttgtcatcttttgagactcaattcaagtgtcttttcctctgacgcttcctcaccagtcttagctcatattcacctagggccatgtgcttacctagttaaatgcttttcctgcaccactggacaccttgaagactgagccttgccttatttagctttatatcccaggtgcttcccacagtgcctcatccatggtgctttctggggaaaggtttcaaagaacgaattggcccaaacaagcacattatttcacttaattgacacaagtctaccactttttctggttattattaatgttctgataaccaactagtcactaacagtgataaaacaccttattatatattaagttctgaaaaaaaagttcatactttttgtgtaacaaattgctaggaatggcataataaaattgattttcctcataagaaaaataatgtcatttggggttattcttcaacctgaatataacgtcaggtatttcatagatctgatcatcaatttaccattaaaacaaggataataactccttttattcaaaatagaaaaaaactgttcaaatttcataaaaggattccagtgtcttcagagatctacatttagcatagaacaactttgatactgggagcgttttccattggtcacacactaggcttagcactttaaaagcattatctggtttaatcctcacagcagtctatgaggtatgtattttttcctcattttgtagatgaggagattgtgacttaaagagattaagttgccaagatcgtaagtgtgacataagcctaacttgctagttgaaatatatattgatcataaaatgagcaggatttttctctcttaattgtaaaaggatttctgtgattaacagctgggtcgacagtgatattttatgaatttttttaccttagtaaattactgagagaaaaaagcaggtctcttagttgcatgtatcgaatatatccaagctttaaggagcttactgtgtagtggaaaagaataggctaatagaaatagattttgagattatttagtccttccttccatgaagtaaggttgtttaaaattataaagcataattttataaagttttctaaaatacttaggaaaaaaagattccaagggccttgatattggtgagttttccacaaatgtttaggaagttctaacagaaatgatttggacttttctttaagctaatttttttaaagctattttgtccacatgagatgagctatagtacctggtcctgaatacagtagtgtcttctttttcagctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttggtgagtatttttcactaaaacttaacttggtctctatatttaacagtagtgtgttgatttctacctgtcaaactgggtgcatgatggagtggctgtcaaaagcacattcatttacctcctacatctcatatgcggtaaaaggagggctaattttttgcattactttatggtaaatctaaatttgaggaccctgtatttttcagtttcagaaaaaaatatagggttcattgttagaatgaaagttatagttctgatttgtttttggtgaaacttaaactttgtaactttgctactgccccattagccattactgacatcttccttctgtgtggaggttaagacacattcatatctgtctttctgcagtgctagtgaactgagtgcttatgggcagttatgttgtccttggctgatccaactcattatataccatcccgtgcttttttttttaattgagctttcttggttttctaggaagatctgtcctaaagttgttagaaaagtttttggttataggtgatttaggaaaaccacttggaaaaaagttagaagacatggtcattgtagttatattcctagtgagtaagtaacaaaatttgttgactgcttggtggtgttctgtaggtttatgggtctcacggacagggtcaggtggctttgtaatctgctcctaaaatctgtagcagcaggagagtaataaggagggagctggcattgctggagcatcacttgaagctcctgtttgctgcagagctgcttgttccaccaaagatggacactcctatcaccctttcccagtcactgctacagggtctcgcctccctttctcaggaaatgatctagttggctggagtataaggccttttggactgtgtaatggagtcctctcaactataatacagacaacagtgatcctcagggggagcttggtggtttgtttttctgcaactctttgaaatggcctcttagataaacccattaattttgtgaaacacagggtctttaaaatctgttgctcgcttggttctctgttagcaaaagtgacttttgccttcagtaagtgaggaatctgtgtgggatatggcctagataatgagattgaagaacttctgccagcaccaagaccaatattttgtgaccctgaagactaagaggcaatttcaaaccttcaaatataaaatgtaatactttatgagctacaatataaatttaaaactaaagttaaatattataagctaggctctggagatacttgttagggttctaaatgtctcaaatgaggtaatgaatgcaaaaacacttggaaaagcatgaggtataagagctataagatatataaaatttctcctctacagcattcattattgtaagactataatttaatttagtaaaactaaaaagggattgataacttaggcccaaaactggtttttgctgcagtttagaagtagaagaaaatttgtaaattttatgcttgatatagtaaacctttcttatgctcttttggcagatgattgtgacgcatgatttggaaccttgcttgacagatattagaaataataaagctatcccttattgagcccttgccaggtgctggcttatgtacctgttatcttttctttaattctcttgtcctcctgcaaacctggaaatgaagaaactttagatgcagggcagttaaatagcttgtccagggcgacagactgaactcgaatttgaatctaggtcttacttcaaaactcatgacctttcctctacaccagatgcctggattaaatattatgcagcatctatatgtcgaactcatcatcttgatatttagtaatgatgatacaaaaattaatgtatctttattagacctaggccctaaactttggtttagattttatttatttatttaaaagctttcagaagtgtttcagacatactataaaatatcagcaaggagagcttctgaaggatttgatactaaacagagaatttcttacattctgaacagattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggtaagattgatgttctcaatgtggatctggctgaaatacccttgtaatattgtcaggtacattttgaagtgaagagttttcaatggtcctcctgtttcaagaacctaatagatgtgtaatatgtaatattaagggttgttgaatagtatggtgatgaccacaaagctgcaaattgttttgctgccccagtgtccttccctcatctttgccctatttaatagtgattattacaggagcaatttgattccagtataaaaactaaggacttttggacccaattataatttaatatttgtttataaatagacggatttgtgaggtatttttaagtttttgttttgctggagagttgatttgttgatctggtgttgccatctagtggaccaatcttagaattacaccgtcttagccttattaaaagatctatttaccaggtgacagtagatggcaatagtaaaaagctaatcagctttagtcgcctagtgaatttaactttttatttagtcatctggtaaagagacaagttatattattcacataaaatataatgccaaactaaaactttcccttcctcttttagttacagaatttctatgtgctgacttattccacctgtcatgtgtttctttttcattttttcctataactagtatgattccactgtgggaaaagaaacacataaacattccaggtttagagctagtactagtaataccaagccaccaaaaagccatatccgaagcttggaaactggagagggaagagaaaagaattctgaaaagagccttgaattgcctgtctatggagtgtgcagaaagtgtttatccctcctgaagtgccttactcccagttagaaatcctgattctagtcccaagctctgacataagtcttaagaaacttttagttatccagagcccctggaacccttataacactatgaagagttattgaggtgcagtgaagaattctttcctaatttaggatgacatttgtggcttgtgtttttacacagaatttctgcttgtcccattgtctctgaggtggaaactttacctagattttccgattatggcagtggagttcttggcagccttatttgtgactgatggtcttattttaagtccagtggctgggtttaagtgtccaaggcctgggtcccattgttttgatctccagttttgaagtcgccgtataggaaacttttttttctgtgacatcccctataccccatgcacttgaataccatagagggctctttctaaactcaaactcaatcttatttctggctgggactccaaaaagattgagaagccccttaattgtagtatagaagtgagatatagcaccatccaaagatttactcccccaaatcttcatatatttgaatcttcatatacatcttcacaatttaaatagcaatactcagtttttactaggatctattgcagtgggtaaggaggtggggatgagggatggggaagggtgtagaagggaagagagtgacatattctgaaaggaaaggaaccgggaagttgcaattttgcgtgtcaagaaaggcctgccttcatctttctgaagccctgttttcatcatgttattcccctgctcaggaagatgcagtgactctctcctgctacctgtgttttccacttctaggcttgatttccaagaccctttataatttggtctcatctactatgtgttattttccagtactccaccctctatttgaggcagccagatctgctcagagatccacacaaatcccttgttcatttctgttgtctggctgctgtgcccacttattgtgggaaaaggagggaataaaaattgggtaatagtaggcactttgatggatttcccacacaaccactttatggtggagatatcatcgtccccaccttgcagactgagaaactgcatctttggaataagatgtacccaatatttcacttgtaagtggcagaaccagggctagaagccgggtctgtgtgactgagtagcccattctctttggagtacatctcacagcctcattttaatcatcttcttcctaaaggtaggaaatgggaaatttgtttagtttatctgtagtgctattttagtaaatctgctctcaatgagtgcacactactcacagtttttagacttgtgttttgagtagaatttcctctcttatacctagatttagtaatttaccagcacagtaatttgattatatgggatagattgtactataactggctacttctatcttgatagtgagcattggttggaatcctttaaagacaatcacaaaattacctttccctgcacacagatgaactctctttgatcaaatttgccttatgtattggctagtttttgttctttaagcattactgagagattgtggctgtggaagaataaaccacacttttattccatttcattcattatctgtgaaattgcctggcaagttctgatgcaagaatcacttattctggaatgtggtatatagaaaaggaaagtttgatcttctctcattccaactctaaatagaataattttatggtgctgatggtatttgtagcactttcaaacttctgatgaaccagaaaggaggtaagggatgtaagtaccagtgttgattgccagtggtttcatgctggtgataatctatggagagaaaactccctctgatgtcagaggacatacaagagagaatgggcttgagttacttagcatttatcttcctgtaaagtagtccagctctgcttagataattaagtgtggattgtcctccctgtgtagctgatgtaggtacttctgtaatattttcctttatgtagtaaaatttcactgtgcaaaattcactgataagacacagaaatgtaaaagccacataattctagatctcattccccccagcccatttccagaatggatttcttggtgtttccagttttatgtgagatatattgcttgatttatgactgggttatgtgcaggctttctttttcttcccacttgcagttagatactgagtaggaagtgaaatattttcagagatcatgttggtttggggtggttgtagcattccagaaggaaagtgttgtacctggtagcatttgtaagaggaaacctggaggagagctcactgtaaaagctctggtagtccctggacagctgaatcttttcccatctttgatagactgctgtggatcagtgagcctagaaccaggattttattgcttccttatagacagatacttcataggggaaaatggtcctccaagtggcattcctggatgagcagcatcagcatcacctgggaacttgttagacatgcacattcaaggggctgccccagatgtactgaatcacgctgtggggtagggccagtgaactgagtttaagaagccctccaggtgatttcagtgctgttcaggtgtgagaagccctcctagagagtcaactctgtggtctttgcagaaaaataattttagatcttttcttctggagttttaaagttttgttagatttaaatgtaaaagttggccccggaatagcttatgttctcccaaaggctcctagcatgccttcattgcctctctttgttgatggaagtttgaataaacattttccctcagaattgtgtggaactttttactttttaatgtgttcatagacaatagtggcattttaaaatattgtattcttaagatgagaagttgttttattgtagaaaaaaaattttctcaggaaacttaaaaatcataactattattgtccagtaatcatttaaagaggcaatgaaatgacttaagtcatgtaacatttaaaactgttgtcaataaagattcttgaagcccatctctgctacaggcttagacttagcaaatcacattctcacctcaattagaagtttggaagcatgtgctgtgaaatgacatatctgtactatgttacaaagggcatattttaaagagtactaatcaactgttttattttgcaggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttaggtaagtgacttttttttttttttaatagcatatgacttatgggctatgttactttgagcacctacttgttatttgtgggagtgataaaaagaattcaacccaaggtgtttggacatctaattgggaagggatgtaagcaaataccaaatagtttacaattatagaaagttatttaattcctagagatgggggcagctctgtggaagggaaaataattgtacaaagcttttaagggtattgtagagttgaactgggctgtgaggataggatttgcatagatagtatcaaaaccatctgaggtagtggtggtagggagagaatgctcaggaggcaccataaataaaagcaagagtatacgactgttgctgctgtacctatagaaatataaggaggggaattgatcggcttaaaatggaaaaatctcatttttgaatttagttaatacttgaaaatagcttgacttttctcagtcatctttacagcctttgtgttaggtaggataatattttatccagaataggtgcttcaaatatgttcagattgaactgtgtccacttcagattggttttgatacacaccactcctttgaagctagaccttactggtagtgacttttcttgattctcagtctcttgactttcgtcttaccttaatttaaaaatatctcttttatagttttctgctctttgctttgactccataaataaaataaaaattaaagaggaagtaggtagtaaggatattagaacaagagttacatattcatagcattaccaatctgaacttacctcagtgatattgaaatcgaaaacatagaaccagtgaggttaattgagtggcctaatgactcaaagctagttagtggcagaactggaactaggaatttaaatctgtgtctgcagtccctattgtctgttttaaaccgcctacttgaaattttgtcctggggttctcataggcattcaaataacactaattccaaaaattaacttactattttctccctctaagttaatactattaccatgtgaccaattagactggctggaaattttatattctgtctctcttgtcttccatattcaatccagtcatgtataaatgtgtacttgaactacagatgctaacacctcatactatcactggtttttaagtttatttcactggttctgttgtgagctcacatatagtatatggctcagagtaggatctcagtatatgctattaaatgcatggctaaatgaaaaatgttttggcttaactcagttgtagatctgggaatgaagggacatagctctctgttgaggctgactttactacatacagatgccactcgagaaccccactgaattatatgattctgtgattgagatctcaaaattatatctattgggataatatttttgtgttacagctggatggattatatatgctttaggacgtgttgaagttacagcaaaaaaatggtatacactcacgttaactattaaggtaagtattgctgattggagtctggaggtaaaatgctcttttgttgtgcatttctataattttctgttataaaataggagggggaaagtgtgacatataatgaagagagacaaagaatctgccttggtgccgggaagccactcatccctaggatagttacatgtgtgagggtaacctatgtgagaaccatcagcagttgactttatcaggtcactatttttttaaaaaattttattttgttttttaaactgaggcataattgatagagtcaataattgaactatttttttcaagtttgcttgaaccaagactgtacatggagcttatagatgtaagcaaagccatatgcatttatttttgatggttaagaataatttggttttcaattataagcataatttttagaaattggtttccatgaatattttagtcagagaaaataccagattaattttagtataatagaaatataaaaatgttcctgagaatcactgggtgatcatgagttactgctcgacagtgcttccaagggatgctgtgcagataaatttttgtgtataatgtgttggtctctcccaagatagctctctcacaattttgtttagagtgcagtagaaattaaaaatcagattccaataactttggaatttgttctctcaaccaccaaaaatgacagcactaattattttttagcattaacaatatgtatattgaagatttggtttggatgtagcatagattatttaactataccacactagccaaattgtagccattttatagcaattataataatattcactattattgaatttgaagattttttccaaactcatagatatgatttgtatttccttgataattagggagcttgcacatctaatgtttactggctatttgtattttctcttctctgaagttgcctgttcacttctttcttcatttttctattgtgttgtctttttctggcaaatttgtgtgaatttaatatgtattctggatagtaacccattgtctgttacatacgtcacaactatgctcttccttcatgtgtattctaattttgcttatggtatttttgatgattataagttttacattttgatactgtcaaatatttcactttttattcattgcttttatgtttcatgttttaaataaggccttcttgtttctcaaggttaggaacatttttcccccaagctaaacaaagtttaggatttatttttatgtgtaagtctttaatacgtcagaaatttacttgtgaattgtaaggggaagtactgaatataattttttaaaaaatggatagccatcatttattacaatggactatccttttgcccataatttaaaggctacctttttgatgtaacaaatcagcacatgtgcacatgcttgtttctgaacttttttctgttctccatattgatgtttgtctattattatccaaaatcacacttttaattggtgttcacattctaaaagctttgatgatacagctactcccttgcttccttcagagttttcttacctgaccacctgatagaaaacagcgccccatctcactctctaactcctttctgttgctttatttttctccaaaagttttatcccaagctgacatcacacatattctgttaattgttcatgtgttttcctactcccttcactagcacatagctcctttagtgacaggcttttctccatattcctcactgctggctctgtagcacctagaaaagtgcctgacagccaggcagagcaagagtccgaataatacttggtaaatgaatgaatggatatctggtggggcaacttcctcattgtttctttttcaaaattatctttgctattccactatatatattattcgatttgacttttaaaaaacaaactttcagttacttgaaaaatggtgctggtattacattaaatttacacatcaatttaggaaaaaatgacttttttttttttaacaataatgtgtttccccatgagagaacacaggaacaaaagcatgctatatttcaccatttattaagatttgccactatgtccttcagttttatttttgcaaacttttgattaggtttgttttagtaattttatgagtttttttgaaatcatgaatgagattttaaaaattttcttaatttttttcaggtactttgcatacctggttaaaatatcaataggatgtgaggcatcttgcctcacatcctgttccttcttcttgaccccattctgtgtcttgtacttctgatacagccactcttcactattttagctgtttcttctggtgtgtctttaatataatgtgattcattacttttaaaaattggctcttgtcttgctactaggatggataggactttgctggcttgcacccacctcactcccctactcctgttattttgtgtttcatcaactatgggcattctgtttcctcttgaatctcagcttttgccacatactctgagggtcttctgtaactatctgcactaaagtagtctgtcaggcacccattgtcaccttgacctggcttaatttttacatgctacttatcttttagctctcattttgtgtgtgtgtgcatatctgtccatctccttctactagaatataagctccataagagcagggaccttgtctttcttgttcatcttaaattcccagtgcattaaacagtatttgacatataaatcttctttgcgtaaataaaaaaaacaaaacatcatcttctatgttgcccatattccaaattacagctaatgtgaggattttgtcactgactatcagccacctgttgaattcttctcagcacttgtcaggtgacttgtcccagttctgttgcatggtgggtagcacaatggactttgaagtctactatattctacttgcaagtattttatattgcacagcttcaattttcccatccatgatatcatgaagaacacttttcttatgaagattcaatgagaaaataaataaatatatatatatatatagtacctgatatgtggtaagcacttaatgagtcaagttaatatttttaggagtaggagtgtttggaaccagacagaccagcattcgtatttcctcactaacacatgctgagacttctagcaagttattccacctctttgagtatccatttccttatctgcaaaatggagataacttctgtgaggttgttttgagggttaaatgtgtttcattcttatattcaacacatttttattaagcccctactgtatgcactttactaagtcctagggatacagcagcgaacgaaacagacaagattcctgctctcttagagcatatattcttctaggacaggggttggcaactttttctgtaaagggccagatagtaaatattttagacttcgtgggccatgtggtctctgctgtggctacccagttcggctattgtaatgagtaaaaaagccatagacaatagacaataatgagaaaaaaagccatagacaatggatgtggctgtgtttcagtaagattttatttattaaaaaaagggcggttggcatgtaggtcatagtttgctgagccctatcctgagataataaacttgtaaataagtttataaatgattatgaagaaaaaatagagtcatgagataaagtagctctgttaccctgattctctaaccagggaggtgaggaaagacctcactgagtgggtagtacttgagtgcagacctgaatgctgggaagaacaatttgagcagaccaagtggcaggtgcaaaaggcaggtgtagctgacattgtgtgaagagcagcctggaggctggggtggctgaagtctggggagtcaggagagataaggtcctgttagacaggttttgtgcttaatgtgatctgtgatttgagtcccttggctcggtgttaatattgagtgtttgatggcagcagaagatgttcagtaagcacttctagagctgaagatagctgtgcaagtctgtagtaataggaatgtggctctgaatttggagctaggtaacttggagtgaaaacctgtgactttgagctttaatctattaagcctcagtgtttccatgcataaaataaaagaactaaattaaggcccattacattatacttccaagacttaaaagcagatttattctggttcttggcccagtgctttgagttttgagctcttcaccttctgagagtagctagttttatatgattgactgtagttagtatgctgtgaatatgtgctcataaatgtactatcataaagataataagagctgagatttattgtttaccatgtgccaggcactgagctaagtagaatggcaacattcggaggaaggtgtaattttttctttcactgtcagtgaccagtaagtcacaccttatagatgcctcccttcttccacccgctgcaccctactccagcatcactttaactgatggttactgtttttccaacttaagggtaggagcttcatatggctttgaagtgatattctattcatggcaacaaaacacaaaaactaaggttaattatttttcttctggctgggcagaggctccttaatgaaaaccttaaggaagcaatgaggtagaagcagatgttttgactccagcagtcatgtctgaagagctggtggctgttagccacaccacttgtacatgtgactacttataaataacttttgttaaattttaatgagcttttttctaaaactttataataatgcctgaaaagttttgcattttgttggttttaaattttggtggagcacaggaaatattgaggtattccttgtacgttgggaacgatttaagtaggtagataagaatttcttcctagagtttttttctgtattttaaacttttgctcaaacttgtggaattgtgttttgctgtggttaagtcttgagtgagtagtacatttgctccactaagtagtgggccatacatgatcaagaaacagacttcagaggaccattttcatatggtttcaaggaatgtgtttctttctactctagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaatgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaatctttgtgtcaaatatatttttatttcttctggatgaatactgaggagtgaaattcctgggtcttatgttaattgtatgtttaactttataagaaactaccaaactgttttccaaaatgattgtatggttttacacttctatcaacaatgtttaaaagttccagttactctgcattcttgtcagtgcttcatgttgtcattctttttaattttaacccttaattgtgggtgtatagtatgtacatttctctgatgactaaagctattgagcagatgtcatggacttaatggacatttatgtactttgttttatgtaatatctattcaaatattttgctcatctaaaaaattctgttttttccattgagttttaagagctctttacatcttccagatacatgttttttttttaaaaaaaaaaagttttgaaaattattttctctatttctgcaaagagcctgatggaattttcattgtgattgcatttaaattatagataaatctggagagaactgatatctgactaatatggacccttcaaatccatgagcagttacacctttttaaaaattttattttactttaagttccaggatacatgtgcagaaggtgcaggtttgttacataggtatacgtgtgccatggtggtttgctgcacctattgacccattcttttaagtgcagggggggggggggggggggggggggggcccctggtatgtgttgttcccctccctgtgtccttgtgttctcattgttcagctcccacttatgagtgagaacatgcagtgtttgattttctcttcctgtgttagtttgctgagcatgacggcttccagcttcatccatgtccctgcaaaggaaatgatctcattctttattatggctgcgtagtattccatggtgtatatgtatcatgttttctttatccagtctatggttgatggatatttgggttggttccataactttgctattgtaaatggtgctgcagtaaacttatgtgtgcatgtgtctttatatcagaatgatttatattcctttgggtgtatacccagtaatgggattgctgggtcaaatggtatttctggttctagatccttgaggaatcaccacactgtcttccacaatggttgaactaatttacattcccaccaacagtgtaaaagcacttctatttctccacagcctcacctgcatctgttctttcttgactttttaataattgccattctgactggcatgagatggtatctcattgtggttttgatttgcatttctctaatgattagtgatgttgagctttttttcatgtttgttgggtaggtaaatgtcttctatttgagtagtgtctgttcatattctttgcccacttttcgatggagttgtttttttactgtacatttaagtagcttgtgaatgcagtatatcaggctttgtcagatggatagactgcaaaaatgttttctcattctgtaggttgcctgttcaatgtgaatgtttgtttcttttgctgtgcagaagctctttagtttaattagatcctgtttgtcaattttggctgtttcgcaattgcttttggcattttcatcatgaagtctttgcccatgcctatgtccttggtggtattgcctagattttcttctagggtttttatagtttgggttttacatttaagtcttttattcatcttgagttaatttttctataaggtgtagggaaggggtccagtttcagttttctgcatatggctagccagttttcccagcaccatttattgaataggagatccttttcccactgcttgtttttgtcaggtttgtcgaagagcagatggttgtagatgtgtggtgttatttctgaagtctctgttctgttccattgatctatatgtctgttttggtaccagtaccatgctggtttggttactgtagtcttatagtatagtttgacatcagctaacatgatgcttccagctttgttctttttgcttaggat
